United States Patent
Walsh et al.

(10) Patent No.: US 11,053,511 B2
(45) Date of Patent: *Jul. 6, 2021

(54) PRODUCTION OF DHA AND OTHER LC PUFAS IN PLANTS

(71) Applicants: Dow AgroSciences LLC, Indianapolis, IN (US); DSM IP ASSETS B.V., TE Heerlen (NL)

(72) Inventors: Terence A. Walsh, Zionsville, IN (US); Daniel Gachotte, Indianapolis, IN (US); Ann Owens Merlo, Carmel, IN (US); Dayakar Reddy Pareddy, Carmel, IN (US); James Metz, Longmont, CO (US); Scott Bevan, Indianapolis, IN (US); Jerry Kuner, Longmont, CO (US)

(73) Assignees: Dow AgroSciences LLC, Indianapolis, IN (US); DSM IP Assets B.V., Heerlen (NL)

(*) Notice: Subject to any disclaimer, the term of this patent is extended or adjusted under 35 U.S.C. 154(b) by 1126 days.

This patent is subject to a terminal disclaimer.

(21) Appl. No.: 14/726,285

(22) Filed: May 29, 2015

(65) Prior Publication Data

US 2015/0320003 A1 Nov. 12, 2015
US 2018/0310512 A9 Nov. 1, 2018

Related U.S. Application Data

(63) Continuation of application No. 14/235,435, filed as application No. PCT/US2012/048355 on Jul. 26, 2012, said application No. 14/235,435 is a continuation-in-part of application No. 13/698,412, filed as application No. PCT/US2011/036869 on May 17, 2011, now abandoned.

(60) Provisional application No. 61/511,878, filed on Jul. 26, 2011, provisional application No. 61/345,537, filed on May 17, 2010.

(51) Int. Cl.
    *C12P 7/64* (2006.01)
    *C12N 15/82* (2006.01)
    *A01H 6/54* (2018.01)

(52) U.S. Cl.
    CPC ......... *C12N 15/8247* (2013.01); *A01H 6/542* (2018.05); *C12P 7/6427* (2013.01); *C12Y 203/01085* (2013.01)

(58) Field of Classification Search
    CPC .............................. C12P 7/6427; A01H 6/542
    See application file for complete search history.

(56) References Cited

U.S. PATENT DOCUMENTS

| | | | |
|---|---|---|---|
| 6,489,542 B1* | 12/2002 | Corbin | C07K 14/325 800/302 |
| 2004/0049806 A1* | 3/2004 | Kunst | C12N 9/1029 800/281 |
| 2004/0172681 A1 | 9/2004 | Voelker et al. | |
| 2004/0172682 A1* | 9/2004 | Kinney et al. | A01H 1/00 800/281 |
| 2007/0244192 A1 | 10/2007 | Metz et al. | |
| 2007/0270494 A1 | 11/2007 | Metz et al. | |
| 2008/0022422 A1* | 1/2008 | Weaver | C12P 7/6472 800/278 |
| 2008/0145475 A1 | 6/2008 | Flatt et al. | |
| 2009/0104700 A1 | 4/2009 | Samuel et al. | |
| 2009/0222951 A1 | 9/2009 | Cirpus et al. | |
| 2011/0039010 A1 | 2/2011 | Rein et al. | |
| 2013/0150599 A1* | 6/2013 | Walsh | C12N 9/1029 554/9 |

FOREIGN PATENT DOCUMENTS

| | | |
|---|---|---|
| CN | 101573451 | 11/2009 |
| JP | 20018667 | 1/2001 |
| JP | 2001527395 | 12/2001 |
| JP | 2003535057 | 11/2003 |
| JP | 2007500134 | 10/2007 |
| JP | 2009500612 | 8/2009 |
| JP | 2011519552 | 7/2011 |
| JP | 2019068806 | 5/2019 |
| WO | 1998046764 | 10/1998 |
| WO | 01/59128 A2 | 8/2001 |
| WO | 03/074715 A2 | 9/2003 |
| WO | 2004071467 | 8/2004 |
| WO | 2005083093 | 9/2005 |
| WO | 2007106903 | 9/2007 |
| WO | 2007106905 | 9/2007 |
| WO | WO-2007106905 A2 * | 9/2007 ............ C12P 7/6472 |
| WO | 2009130291 | 10/2009 |

(Continued)

OTHER PUBLICATIONS

Friedberg (Automated protein function prediction—the genomic challenge. Brief. Bioinformatics. 7:225-242, 2006).*

(Continued)

*Primary Examiner* — Ashley K Buran
*Assistant Examiner* — Wayne Zhong
(74) *Attorney, Agent, or Firm* — Magleby, Cataxinos & Greenwood, P.C.

(57) ABSTRACT

The invention provides recombinant host organisms genetically modified with a polyunsaturated fatty acid (PUFA) synthase system and one or more accessory proteins that allow for and/or improve the production of PUFAs in the host organism. The present invention also relates to methods of making and using such organisms as well as products obtained from such organisms.

22 Claims, 40 Drawing Sheets

Specification includes a Sequence Listing.

(56) References Cited

FOREIGN PATENT DOCUMENTS

| WO | 2010119319 A1 | 10/2010 |
|---|---|---|
| WO | 2001089474 | 11/2011 |
| WO | 2013016546 | 1/2013 |

OTHER PUBLICATIONS

International Search Report and Written Opinion for International Application PCT/US2012/048355, dated Jan. 25, 2013.
International Preliminary Report on Patentability for International Application PCT/US2012/048355, dated Jan. 28, 2014.
Bates et al., The significance of different diacylglycerol synthesis pathways on plant oil composition and bioengineering; Frontiers in Plant Sciences; Jul. 2, 2012; vol. 3, Article 147; 11 pgs.
Cheng et al., Towards the production of high levels of eicosapentaenoic acid in transgenic plants: the effects of different host species, genes and promoters; Transgenic Res (2010) 19:221-229.
Napier et al., Tailoring plant lipid composition: designer oilseeds come of age: Science Direct; Current Opinion in Plant Biology 2010, 13:330-337.
Naqvi et al., When more is better: multigene engineering in plants; Cell Press; Trends in Plant Science vol. 15 No. 1; 2009; pp. 48-56.
Peremarti et al., Promoter diversity in multigene transformation; Plant Mol. Biol. (2010) 73:363-378.
Que et al., Trait stacking in transgenic crops Challenges and opportunities; GM Crops 1:4, 220-229; Jul./Aug./Sep./Oct. 2010.
Ruiz-Lopez et al., Successful high-level accumulation of fish oil omega-3 long-chain polyunsaturated fatty acids in a transgenic oilseed crop; The Plant Journal (2014) 77, 198-208.
Murray, et al.; Codon usage in plant genes; Nucleic Acids Research; vol. 17 No. 2 1989; 22 pgs.
Robert, Stanley S.; Production of Eicosapentaenoic and Docosahexaenoic Acid-Containing Oils in Transgenic Land Plants for Human and Aquaculture Nutrition; Marine Biotechnology; Dec. 26, 2005; 7 pgs.
Office Action for Taiwan Application No. 101126777, dated Aug. 18, 2017, 11 pages.
Official Decision of Grant for Russian Application No. 2014106985, dated Aug. 23, 2017, 21 pages.
Costa, et al., "Advances in vegetable oil authentication by DNA-based markers," Trends in Food Science & Technology 26, 2012, pp. 43-55.
Extended European Search Report for European Application No. 18213416.3, dated Feb. 18, 2019, 11 pages.
Gryson, et al., "Detection of DNA during the Refining of Soybean Oil," JAOCS, vol. 19, No. 2, Jan. 1, 2002, pp. 171-174.
Bogani, et al., "Transgenes monitoring in an industrial soybean processing chain by DNA-based conventional approaches and biosensors," Food Chemistry vol. 113 No. 2, Mar. 15, 2009, pp. 658-664.
Gryson, et al., "Influence of Different Oil-Refining Parameters and Sampling Size on the Detection of Genetically Modified DNA in Soybean Oil," JAOCS, vol. 81, No. 3, Jan. 1, 2004, 4 pages.
Office Action for European Application No. 18213416.3, dated Jul. 7, 2020, 7 pages.
Hudson, et al., "Optimizing Recombinant Protein Expression in Soybean," Soybean—Molecular Aspects of Breeding, pp. 19-42, Jan. 1 2011.

\* cited by examiner

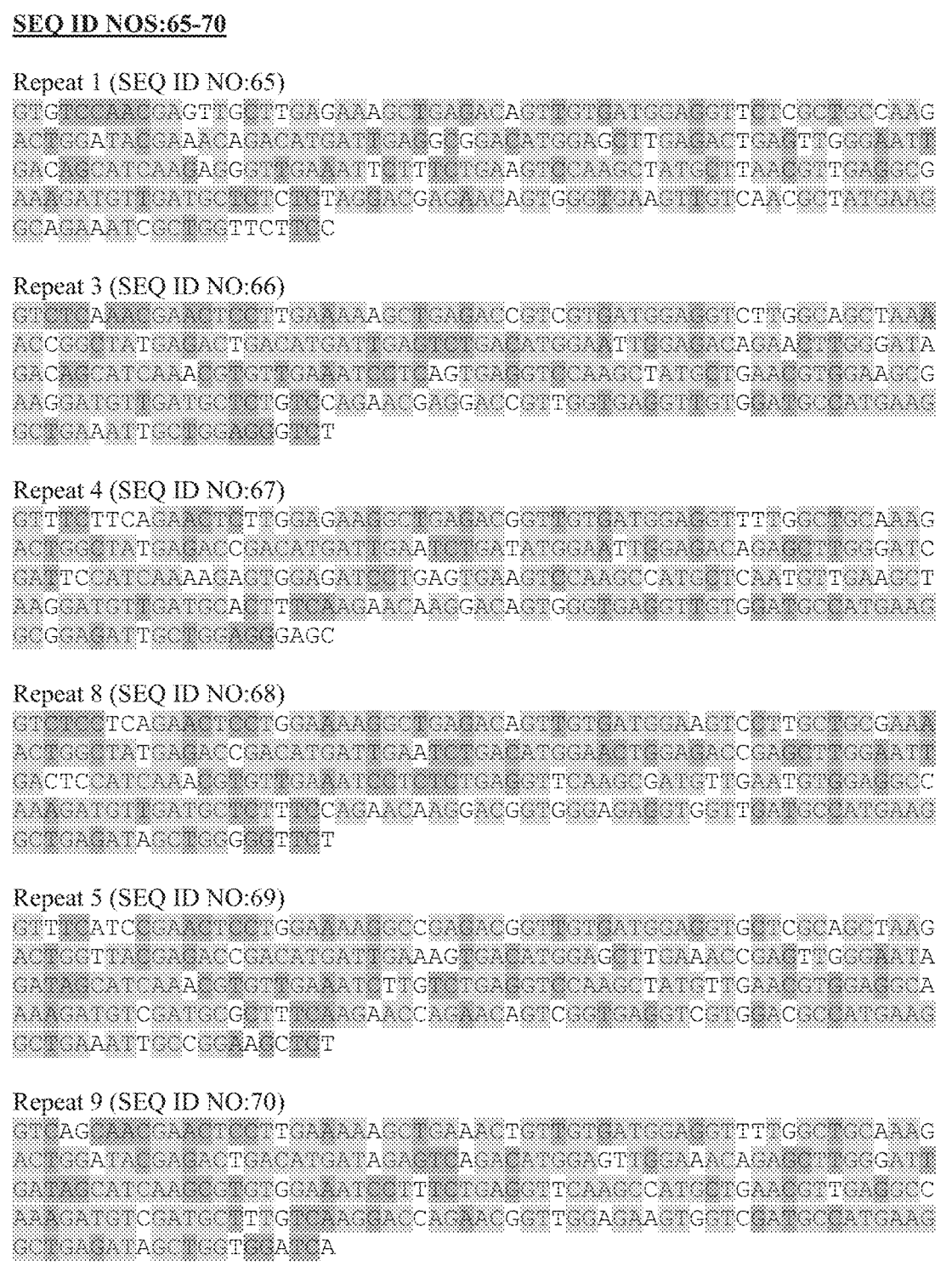

SEQ ID NOS:65-70

Repeat 1 (SEQ ID NO:65)

Repeat 3 (SEQ ID NO:66)

Repeat 4 (SEQ ID NO:67)

Repeat 8 (SEQ ID NO:68)

Repeat 5 (SEQ ID NO:69)

Repeat 9 (SEQ ID NO:70)

FIG. 1

SEQ ID NOS:71-73

Repeat 2 (SEQ ID NO:71)
GTTTTTATCAGTTGTTCGAGAAGCCAGAAACTGTTGTGATGGAAGTCTTTGCTGCCAAA
ACTGGTTACGAAACTGACATGATACAAGAGAGATGGAGTTCATACGGAATTGGCATT
GATTCCATCAAGACAGTGGAGATTGTTAGTGAAGTCAAGCATCGTCAATGTTGAAGCT
AAGGATGTGCATGCTTTCTGAAGGACCACAACTGTCGGGAAGTTGTCAATGCTATGAAG
GCTGAGATAGTTGCTGGCCGGC Repeat 6 (SEQ ID NO:72)
GTCAGTAATCAGTTGTTGGAGAAAGCCCAAACAGTTGTGATGGAAGTCTTTGCTGCAAAG
ACTGGTTACGAAACGGACATGATTGATTAGAGATGGATTTGATACCGAAGTTGCTATA
GATTCCATCAAGACAGTGGAGATTGTTAGTGAAGTGCAAGCCATGCTCAAGGTTGAGGCT
AAAGATGTTGATCCATTCAGTAGGACAAGAACTGTGCGGCAACTTCTCATGCGATGAAG
GCTGAGATTGCTGGAGGCTTT Repeat 7 (SEQ ID NO:73)
GTCAGTAATGATTGCTTGAGAAGCCTAAACAGTTGTCATGGAAGTGTTGCCTGCAAAG
ACCGGTATGAATTGACATGATTCAGTTGAGATGGAGTTCATACGCAATTGGGCATT
GACTGCATCAAGACAGTTGAGATTGTTAGTGAAGTCCAAGCAATCGTCAATGTTGAGGCT
AAGGATGTGCATGCCTTCTGAAGGACCACAACTTGCTGAAGTCCTTATGCGATGAAG
GCGGAGATCCCTGCAATTGC A, probed with anti-OrfA antibody, Lane 1, Molecular Weight Markers; Lane 2, 100 ng purified OrfA; Lane 3, 50 ng purified OrfA ; Lane 4, 25 ng purified OrfA; Lane 5, 12.5 ng purified OrfA; Lane 6.25 ng OrfA; Lane 7, Williams 82 (negative control); Lane 8, 7362[708]-70801.Sx.021; Lane 9, 7362[708]-70801.Sx.021; Lane 10, 7362[708]-70801.Sx.021; Lane 11, 7362[708]-70801.Sx.021; Lane 12, 7362[710]-71005.Sx.006; Lane 13, 7362[710]-71005.Sx.010; Lane 14, 7362[710]-71005.Sx.010; Lane 15, 7362[710]-71005.Sx.013; Lane 16, 7362[710]-71005.Sx.018; Lane 17, 7362[710]-71005.Sx.025; Lane 18, 7362[710]-71005.Sx.036; Lane 19, 7362[710]-71005.Sx.036; Lane 20, 7362[710]-71005.Sx.036.

B, probed with the anti-SzORFB v3 and hThSzORFCv3 antibodies: Lane 1, Molecular weight marker; Lane 2, 100 ng purified OrfB; Lane 3, 50 ng purified OrfB; Lane 4, 25 ng purified OrfB (25 ng); Lane 5, 12.5 ng purified OrfB; Lane 6, 6.25 ng purified OrfB; Lane 7, Williams 82 (negative control); Lane 8, 7362[708]-70801.Sx.021; Lane 9, 7362[708]-70801.Sx.021; Lane 10, 7362[708]-70801.Sx.021; Lane 11, 7362[708]-70801.Sx.021; Lane 12, 7362[710]-71005.Sx.006; Lane 13, 7362[710]-71005.Sx.010; Lane 14, 7362[710]-71005.Sx.010; Lane 15, 7362[710]-71005.Sx.013; Lane 16, 7362[710]-71005.Sx.018; Lane 17, 7362[710]-71005.Sx.025; Lane 18, 7362[710]-71005.Sx.036; Lane 19, 7362[710]-71005.Sx.036; Lane 20, 7362[710]-71005.Sx.036.

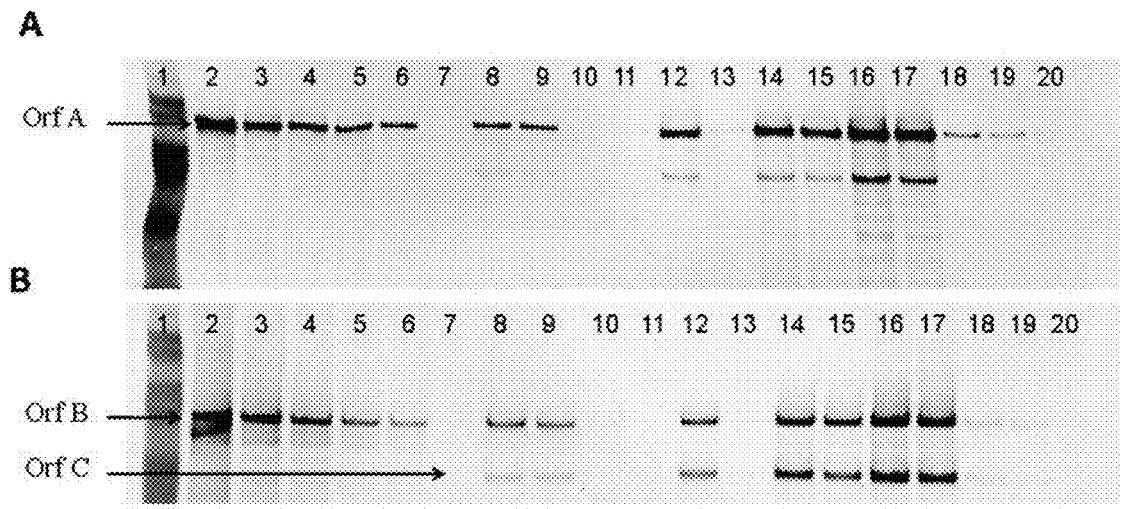

FIG. 13

PRODUCTION OF DHA AND OTHER LC PUFAS IN PLANTS

CROSS-REFERENCE TO RELATED APPLICATIONS

This application is a continuation of U.S. patent application Ser. No. 14/235,435, filed Apr. 4, 2014, pending, which is a continuation-in-part of U.S. patent application Ser. No. 13/698,412, filed Feb. 12, 2013, which is a national phase entry under 35 U.S.C. § 371 of International Patent Application PCT/US2011/036869, filed May 17, 2011, published in English as International Patent Publication WO 2011/146524 A1 on Nov. 24, 2011, which claims priority to U.S. Provisional Patent Application No. 61/345,537, filed May 17, 2010, the disclosure of each of which is hereby incorporated herein in its entirety by this reference.

Furthermore, U.S. patent application Ser. No. 14/235,435, filed Apr. 4, 2014, pending, is also a national phase entry under 35 U.S.C. § 371 of International Patent Application PCT/US2012/048355, filed Jul. 26, 2012, designating the United States of America and published in English as International Patent Publication WO 2013/016546 A2 on Jan. 31, 2013, which claims the benefit under Article 8 of the Patent Cooperation Treaty and under 35 U.S.C. § 119(e) to U.S. Provisional Patent Application Ser. No. 61/511,878, filed Jul. 26, 2011, the disclosure of each of which is hereby incorporated herein in its entirety by this reference.

STATEMENT ACCORDING TO 37 C.F.R. § 1.821(c) or (e)—SEQUENCE LISTING SUBMITTED AS A TXT AND PDF FILES

Pursuant to 37 C.F.R. § 1.821(c) or (e), files containing a TXT version and a PDF version of the Sequence Listing have been submitted concomitant with this application, the contents of which are hereby incorporated by reference.

BACKGROUND OF THE INVENTION

Field of the Invention

The present invention generally relates to recombinant host organisms (e.g., plants) genetically modified with a polyunsaturated fatty acid (PUFA) synthase system and one or more accessory proteins that allow for and/or improve the production of PUFAs in the host organism. The present invention also relates to methods of making and using such organisms (e.g., to obtain PUFAs) as well as products obtained from such organisms (e.g., oil and seed).

Background Art

Polyunsaturated fatty acids (PUFAs) are considered to be useful for nutritional applications, pharmaceutical applications, industrial applications, and other purposes. However, the current supply of PUFAs from natural sources (e.g., fish oils) and from chemical synthesis is not sufficient for long-term commercial needs.

Vegetable oils derived from plants (e.g., oil seed crops) are relatively inexpensive and do not have the contamination issues associated with fish oils. However, the PUFAs found in commercially-developed plants and plant oils do not typically include more saturated or longer-chain PUFAs, and only typically include fatty acids such as linoleic acid (eighteen carbons with 2 double bonds, in the delta 9 and 12 positions—18:2 delta 9,12) and linolenic acid (18:3 delta 9,12,15).

The production of more unsaturated or longer-chain PUFAs in plants by the modification of the fatty acids endogenously produced by plants has been described. For example, the genetic modification of plants with various individual genes encoding fatty acid elongases and/or desaturases has been described as resulting in the generation of leaves or seeds containing significant levels of longer-chain and more unsaturated PUFAs such as eicosapentaenoic acid (EPA), but also containing significant levels of mixed shorter-chain and less unsaturated PUFAs (Qi et al., Nature Biotech. 22:739 (2004); WO 04/071467; Abbadi et al., Plant Cell 16:1 (2004); Napier and Sayanova, Proceedings of the Nutrition Society 64:387-393 (2005); Robert et al., Functional Plant Biology 32:473-479 (2005); U.S. Appl. Pub. No. 2004/0172682, U.S. Appl. No. 61/345,537, filed May 17, 2010).

Fabaceae (or Leguminosae) is a large and economically important family of flowering plants, which is commonly known as the legume family, pea family, bean family or pulse family. *Glycine* is a genus in the family Fabaceae and includes, for example, *Glycine albicans*, *Glycine aphyonota*, *Glycine arenari*, *Glycine argyrea*, *Glycine canescens*, *Glycine clandestine*, *Glycine curvata*, *Glycine cyrtoloba*, *Glycine falcate*, *Glycine gracei*, *Glycine hirticaulis*, *Glycine hirticaulis* subsp. *leptosa*, *Glycine lactovirens*, *Glycine latifolia*, *Glycine latrobeana*, *Glycine microphylla*, *Glycine montis-douglas*, *Glycine peratosa*, *Glycine pescadrensis*, *Glycine pindanica*, *Glycine pullenii*, *Glycine rubiginosa*, *Glycine stenophita*, *Glycine syndetika*, *Glycine tabacina*, *Glycine tomentella*, *Glycine soja*, and *Glycine max* (soybean). The family Fabaceae also includes peanut, beans (*Phaseolus vulgaris*), broad beans (*Vicia faba*) or peas (*Pisum sativum*).

The majority of soybean oil is in the form of vegetable oils produced for human consumption. There is also a growing market for the use of soybean oil in industrial applications.

BRIEF SUMMARY OF THE INVENTION

There is a need in the art for a relatively inexpensive method to efficiently and effectively produce quantities (e.g., commercial quantities) of longer-chain or more unsaturated PUFAs in plants, plant seed or plant oil, as well as quantities of lipids (e.g., triacylglycerol (TAG) and phospholipid (PL)) enriched in such PUFAs in plants, plant seed or plant oil. A system for providing and improving PUFA production in host organisms (e.g., plants) by providing recombinant host organisms genetically modified with a polyunsaturated fatty acid (PUFA) synthase and one or more accessory proteins, as described herein, is a significant alternative to the approaches in the art.

The present invention is directed to genetically modified plants (e.g., plants of the family Fabaceae or the genus *Glycine* such as soybean), descendants, seeds, cells, tissues, or parts thereof, comprising (i) a nucleic acid sequence encoding a polyunsaturated fatty acid (PUFA) synthase (e.g., an algal PUFA synthase) that produces at least one PUFA; and (ii) a nucleic acid sequence encoding a phosphopantetheinyl transferase (PPTase) that transfers a phosphopantetheinyl cofactor to an PUFA synthase system (e.g., an algal PUFA synthase system) ACP domain.

In some embodiments of the present invention, the PUFA synthase comprises an amino acid sequence that is 80% to 99% identical to the amino acid sequence of SEQ ID NO:1 or comprises the amino acid sequence of SEQ ID NO: 1. In some embodiments, the nucleic acid sequence encoding the PUFA synthase comprises a nucleic acid sequence 80% to 99% identical to the nucleic acid sequence of SEQ ID NO:6 or comprises the nucleic acid sequence of SEQ ID NO:6. In some embodiments, the PUFA synthase comprises an amino acid sequence that is 80% to 99% identical to the amino acid sequence of SEQ ID NO:2 or comprises the amino acid sequence of SEQ ID NO:2. In some embodiments, the nucleic acid sequence encoding the PUFA synthase comprises a nucleic acid sequence that is 80% to 99% identical to the nucleic acid sequence of SEQ ID NO:7 or comprises the nucleic acid sequence of SEQ ID NO:7. In some embodiments, the PUFA synthase comprises an amino acid sequence that is 80% to 99% identical to the amino acid sequence of SEQ ID NO:3 or comprises the amino acid sequence of SEQ ID NO:3. In some embodiments, the nucleic acid sequence encoding the PUFA synthase comprises a nucleic acid sequence that is 80% to 99% identical to the nucleic acid sequence of SEQ ID NO:8 or comprises the nucleic acid sequence of SEQ ID NO:8. In some embodiments, the PUFA synthase comprises the amino acid sequence of SEQ ID NOs: 1, 2, or 3 or any combination thereof. In some embodiments, the nucleic acid sequence encoding the PUFA synthase comprises the nucleic acid sequence of SEQ ID NOs: 6, 7 or 8 of any combination thereof.

In some embodiments, the PPTase comprises an amino acid sequence that is 80% to 99% identical to SEQ ID NO:5 or comprises the amino acid sequence of SEQ ID NO:5. In some embodiments, the nucleic acid sequence encoding the PPTase is 80% to 99% identical to the nucleic acid sequence of SEQ ID NO:10 or comprises the nucleic acid sequence of SEQ ID NO:10.

In some embodiments, the nucleic acid sequences of (i) and (ii) are contained in a single recombinant expression vector. In some embodiments, the nucleic acid sequences of (i) and (ii) are contained in different recombinant expression vectors. In some embodiments, the nucleic acid sequence(s) of (i) and/or (ii) are operably linked to a seed-specific promoter. In some embodiments, the nucleic acid sequence(s) of (i) and/or (ii) are operably linked to a promoter selected from PvDlec2, PvPhaseolin, LfKCS3, FAE 1, BoACP and BnaNapinC. In some embodiments, the nucleic acid sequence(s) of (i) and/or (ii) are operably linked to a leaf-specific promoter. In some embodiments, the nucleic acid sequence(s) of (i) and/or (ii) are operably linked to a ubiquitin or CsVMV promoter.

In some embodiments, the genetically modified plant, descendant, seed, cell, tissue, or part thereof further comprises (iii) a nucleic acid sequence encoding an acyl-CoA synthetase (ACoAS) that catalyzes the conversion of long chain PUFA free fatty acids (PFFA) to acyl-CoA. In some embodiments, the ACoAS comprises an amino acid sequence that is 80% to 99% identical to SEQ ID NO:4 or comprises the amino acid sequence of SEQ ID NO:4. In some embodiments, the ACoAS comprises a nucleic acid sequence that is 80% to 99% identical to the nucleic acid sequence of SEQ ID NO:9 or comprises the nucleic acid sequence of SEQ ID NO:9. In some embodiments, the nucleic acid sequence encoding the ACoAS comprises the nucleic acid sequence of SEQ ID NO:34. In some embodiments, the nucleic acid sequences of (i), (ii) and/or (iii) are contained in a single recombinant expression vector. In some embodiments, the nucleic acid sequences of (i), (ii) and (iii) are contained in different recombinant expression vectors. In some embodiments, the nucleic acid sequences of (i) and (ii) are contained in a single recombinant expression vector and the nucleic acid sequence of (iii) is contained in a different recombinant expression vector. In some embodiments, the nucleic acid sequences of (i) and (iii) are contained in a single recombinant expression vector and the nucleic acid sequence of (ii) is contained in a different recombinant expression vector. In some embodiments, the nucleic acid sequences of (ii) and (iii) are contained in a single recombinant expression vector and the nucleic acid sequence of (i) is contained in a different recombinant expression vector. In some embodiments, the nucleic acid sequence(s) of (i), (ii) and/or (iii) are operably linked to a seed-specific promoter. In some embodiments, the nucleic acid sequence(s) of (i), (ii) and/or (iii) are operably linked to a promoter selected from PvDlec2, LfKCS3, FAE 1, BoACP and BnaNapinC. In some embodiments, the nucleic acid sequence(s) of (i), (ii) and/or (iii) are operably linked to a leaf-specific promoter. In some embodiments, the nucleic acid sequence(s) of (i), (ii) and/or (iii) are operably linked to a ubiquitin or CsVMV promoter.

In some embodiments, the genetically modified plant, descendant, cell, tissue, or part thereof further comprises a nucleic acid sequence encoding an acetyl CoA carboxylase (ACCase) and/or a nucleic acid sequence encoding a type 2 diacylglycerol acyltransferase (DGAT2).

In some embodiments, the genetically modified plant, descendant, cell, tissue, seed or part thereof comprising at least one of pDAB7361, pDAB7362, pDAB7363, pDAB7368, pDAB7369, pDAB7370, pDAB100518, pDAB101476, pDAB101477, pDAB9166, pDAB9167, pDAB7379, pDAB7380, pDAB9323, pDAB9330, pDAB9337, pDAB9338, pDAB9344, pDAB9396, pDAB101412, pDAB7733, pDAB7734, pDAB101493, pDAB109507, pDAB109508, pDAB109509, pDAB9151, pDAB108207, pDAB108208, pDAB108209, pDAB9159, pDAB9147, pDAB108224, and pDAB108225.

In some embodiments, a genetically modified plant, descendant, cell, tissue, seed, or part thereof or an oil (e.g., a seed oil) obtained from the genetically modified plant, descendant, seed, cell, tissue, or part thereof comprises detectable amounts of DHA (docosahexaenoic acid (C22:6, n-3)), DPA(n-6) (docosapentaenoic acid (C22:5, n-6)) and/or EPA (eicosapentaenoic acid (C20:5, n-3)). In some embodiments, the genetically modified plant, descendant, cell, tissue, seed, or part thereof or an oil (e.g., a seed oil) obtained from the genetically modified plant, descendant, seed, cell, tissue, or part thereof comprises 0.01% to 15% DHA by weight of total fatty acids, 0.05% to 10% DHA by weight of total fatty acids, or 0.05% to 5% DHA by weight of total fatty acids. In some embodiments, the genetically modified plant, descendant, cell, tissue, seed, or part thereof or an oil (e.g., a seed oil) obtained from the genetically modified plant, descendant, seed, cell, tissue, or part thereof comprises 0.01% to 10% EPA by weight of total fatty acids, 0.05% to 5% EPA by weight of total fatty acids, or 0.05% to 1% EPA by weight of total fatty acids. In some embodiments, the genetically modified plant, descendant, cell, tissue, seed, or part thereof or an oil (e.g., a seed oil) obtained from the genetically modified plant, descendant, seed, cell, tissue, or part thereof comprises 0.01% to 10% DPA(n-6) by weight of total fatty acids, 0.01% to 5% DPA(n-6) by weight of total fatty acids, or 0.01% to 1% DPA(n-6) by weight of total fatty acids. In some embodiments, the genetically modified plant, descendant, cell, tissue, seed, or part thereof or an oil (e.g., a seed oil) obtained from the genetically modified plant, descendant, seed, cell, tissue, or part thereof comprises a ratio of EPA:DHA of 1:1 to 1:10 or 1:1 to 1:3 by weight of total fatty acids. In some embodiments, the genetically modified plant, descendant, cell, tissue, seed, or part thereof or an oil (e.g., a seed oil) obtained from the genetically modified plant, descendant, seed, cell, tissue, or part thereof comprises a ratio of DPA(n-6):DHA of 1:1 to 1:10 or 1:1 to 1:3 by weight of total fatty acids. In some embodiments, the oil (e.g., a seed oil) obtained from a genetically modified plant, descendant, cell, tissue, seed, or part thereof comprises 70% to 99% triglycerides by weight of the oil.

In some embodiments, the detectable amounts of DHA, DPA(n-6) and/or EPA are also found in grain and/or meal obtained from the genetically modified plant, descendant, tissue, seed, or part thereof.

The present invention is directed to an oil (e.g., a seed oil) or a seed obtained from a genetically modified plant (e.g., soybean), descendant, cell, tissue, or part thereof described herein. The present invention is directed to a food product comprising an oil (e.g., a seed oil) obtained from a genetically modified plant (e.g., soybean), descendant, cell, tissue, or part thereof described herein. The present invention is also directed to a functional food comprising an oil (e.g., a seed oil) or a seed obtained from a genetically modified plant (e.g., soybean), descendant, cell, tissue, or part thereof described herein. The present invention is directed to a pharmaceutical product comprising an oil (e.g., a seed oil) or a seed obtained from a genetically modified plant (e.g., soybean), descendant, cell, tissue, or part described herein.

The present invention is directed to a method to produce an oil comprising at least one LC-PUFA, comprising recovering oil from a genetically modified plant (e.g., soybean), descendant, cell, tissue, or part thereof described herein or from a seed of a genetically modified plant (e.g., soybean), descendant, cell, tissue, or part thereof described herein. The present invention is also directed to a method to produce an oil comprising at least one LC-PUFA, comprising growing a genetically modified plant (e.g., soybean), descendant, cell, tissue, or part thereof described herein. The present invention is also directed to a method to produce at least one LC-PUFA in a seed oil, comprising recovering oil from a seed of a genetically modified plant (e.g., soybean), descendant, cell, tissue, or part thereof described herein.

The present invention is directed to a method to produce at least one PUFA in a seed oil, comprising growing a genetically modified plant (e.g., soybean), descendant, cell, tissue, or part thereof described herein. The present invention is also directed to a method to provide a supplement or therapeutic product containing at least one PUFA to an individual, comprising providing to the individual a genetically modified plant (e.g., soybean), descendant, cell, tissue, or part thereof of described herein, an oil described herein, a seed described herein, a food product described herein, a functional food described herein, or a pharmaceutical product described herein. In some embodiments, a PUFA contained in such embodiments is DHA, DPA(n-6) and/or EPA.

The present invention is directed to a method to produce a genetically modified plant (e.g., soybean), descendant, cell, tissue, or part thereof described herein, comprising transforming a plant or plant cell with (i) a nucleic acid sequence encoding a PUFA synthase (e.g., an algal PUFA synthase) that produces at least one polyunsaturated fatty acid (PUFA); and (ii) a nucleic acid sequence encoding a phosphopantetheinyl transferase (PPTase) that transfers a phosphopantetheinyl cofactor to an PUFA synthase (e.g., an algal PUFA synthase) ACP domain. In some embodiments, the method further comprises transforming the plant or plant cell with (iii) a nucleic acid sequence encoding an acyl-CoA synthetase (ACoAS) that catalyzes the conversion of long chain PUFA free fatty acids (FFA) to acyl-CoA.

BRIEF DESCRIPTION OF DRAWINGS

The various embodiments of the invention can be more fully understood from the following detailed description, the figures, and the accompanying sequence descriptions, which form a part of this application.

FIG. 1 depicts the Clustal W (alignments in Vector NTI) of the redesigned DNA sequences encoding each of the 9 repeat domains of PUFA OrfA. These sequences include, in order: Repeat 1 (SEQ ID NO:65), Repeat 3 (SEQ ID NO:66), Repeat 4 (SEQ ID NO:67), Repeat 8 (SEQ ID NO:68), Repeat 5 (SEQ ID NO:69), Repeat 9 (SEQ ID NO:70), Repeat 2 (SEQ ID NO:71), Repeat 6 (SEQ ID NO:72), and Repeat 7 (SEQ ID NO:73).

FIG. 13 shows Western blot detection of PUFA synthase OrfA, PUFA synthase OrfB, and PUFA synthase chimeric OrfC in T2 soybean seed protein extracts.

DETAILED DESCRIPTION OF THE INVENTION

Figure 2:
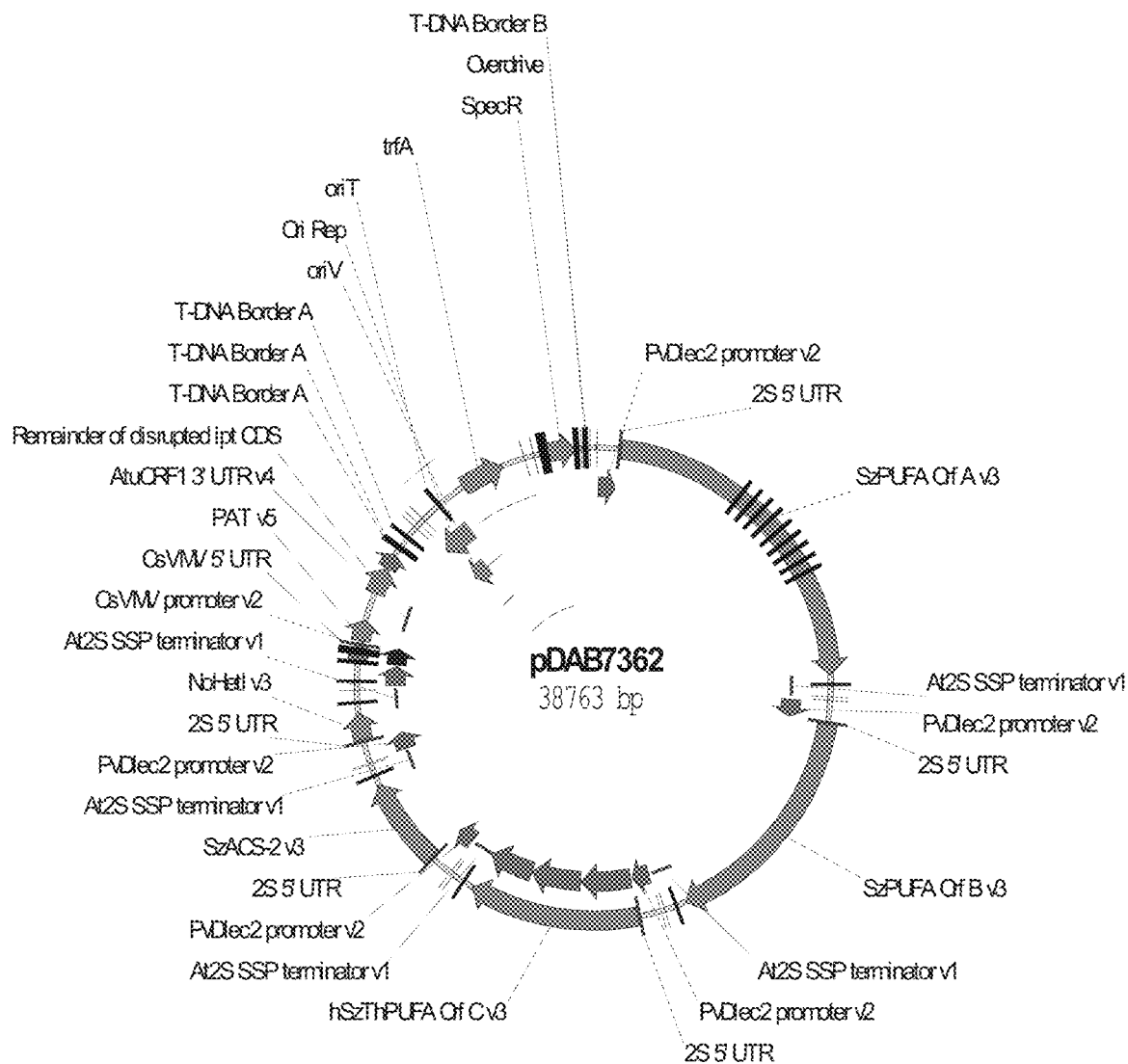
FIG. 2 is a plasmid map of pDAB7362.

The term "polyunsaturated fatty acid" or "PUFA" as used herein refers to fatty acids with a carbon chain length of at least 16 carbons, at least 18 carbons, at least 20 carbons, or 22 or more carbons, with at least 3 or more double bonds, 4 or more double bonds, 5 or more double bonds, or 6 or more double bonds, wherein all double bonds are in the cis configuration.

The term "long chain polyunsaturated fatty acids" or "LC-PUFAs" as used herein refers to fatty acids of 20 and more carbon chain length, containing 3 or more double bonds, or 22 or more carbons, with at least 3 or more double bonds, 4 or more double bonds, 5 or more double bonds, or 6 or more double bonds. LC-PUFAs of the omega-6 series include, but are not limited to, di-homo-gamma-linolenic acid (C20:3n-6), arachidonic acid (C20:4n-6), adrenic acid (also called docosatetraenoic acid or DTA) (C22:4n-6), and docosapentaenoic acid (C22:5n-6). LC-PUFAs of the omega-3 series include, but are not limited to, eicosatrienoic acid (C20:3n-3), eicosatetraenoic acid (C20:4n-3), eicosapentaenoic acid (C20:5n-3), docosapentaenoic acid (C22:5n-3), and docosahexaenoic acid (C22:6n-3). LC-PUFAs also include fatty acids with greater than 22 carbons and 4 or more double bonds including but not limited to C28:8(n-3).

The term "PUFA synthase" as used herein refers to an enzyme that produces polyunsaturated fatty acids (PUFAs) and particularly, long chain PUFAs (LC-PUFAs) as well as any domain of such an enzyme in a complex. The term PUFA synthase includes, but is not limited to, PUFA PKS systems or PKS-like systems for the production of PUFAs. Some specific PUFA synthases are designated herein by an additional notation, e.g., "SzPUFA" synthase or "hSzTh-PUFA" synthase, as defined in the application. The term "PUFA synthase system" includes a PUFA synthase and any accessory enzymes that can affect the function of the PUFA synthase when expressed in a heterologous organism (e.g., a PPTase or ACS).

The terms "phosphopantetheinyl transferase" and "PPTase" as used herein refer to an enzyme that activates a PUFA synthase by transferring a cofactor (e.g., 4-phosphopantetheine) from coenzyme A (CoA) to one or more ACP domains present in the PUFA synthase. One example of a PPTase that can activate one or more ACP domains of a PUFA synthase described herein is the Het I protein of *Nostoc* sp. PCC 7120 (formerly called *Anabaena* sp. PCC 7120), designated herein as "NoHetI."

The terms "acyl-CoA synthetase," "ACoAS" and "ACS" as used herein refer to an enzyme that catalyzes the conversion of long chain polyunsaturated free fatty acids (FFA) to acyl-CoA. Some specific acyl-CoA synthetases are designated herein by an additional notation, e.g., "SzACS-2," as defined in the application.

The term "plant" as used herein includes any descendant, cell, tissue, seed, seed oil, or part thereof.

"Nutraceutical" means a product isolated, purified, concentrated, or produced from plants that provides a physiological benefit or provides protection against disease, including processed foods supplemented with such products, along with foods produced from crops that have been genetically engineered to contain enhanced levels of such physiologically-active components.

"Functional food" means a food that (a) is similar in appearance to or can be a conventional food that is consumed as part of a usual diet and (b) has enhanced nutritional value and/or specific dietary benefits based on a modification in the proportion of components that typically exist in the unmodified food.

The terms "polynucleotide" and "nucleic acid" are intended to encompass a singular nucleic acid as well as plural nucleic acids, a nucleic acid molecule or fragment, variant, or derivative thereof, or construct, e.g., messenger RNA (mRNA) or plasmid DNA (pDNA). A polynucleotide or nucleic acid can contain the nucleotide sequence of the full-length cDNA sequence, or a fragment thereof, including the untranslated 5' and 3' sequences and the coding sequences. A polynucleotide or nucleic acid can be composed of any polyribonucleotide or polydeoxyribonucleotide, which can be unmodified RNA or DNA or modified RNA or DNA. For example, a polynucleotide or nucleic acid can be composed of single- and double-stranded DNA, DNA that is a mixture of single- and double-stranded regions, single- and double-stranded RNA, and RNA that is a mixture of single- and double-stranded regions, hybrid molecules comprising DNA and RNA that can be single-stranded or, more typically, double-stranded or a mixture of single- and double-stranded regions. These terms also embrace chemically, enzymatically, or metabolically modified forms of a polynucleotide or nucleic acid.

A polynucleotide or nucleic acid sequence can be referred to as "isolated" in which it has been removed from its native environment. For example, a heterologous polynucleotide or nucleic acid encoding a polypeptide or polypeptide fragment having dihydroxy-acid dehydratase activity contained in a vector is considered isolated for the purposes of the present invention. Further examples of an isolated polynucleotide or nucleic acid include recombinant polynucleotides maintained in heterologous host cells or a purified (partially or substantially) polynucleotide or nucleic acid in solution. An isolated polynucleotide or nucleic acid according to the present invention further includes such molecules produced synthetically. An isolated polynucleotide or nucleic acid in the form of a polymer of DNA can be comprised of one or more segments of cDNA, genomic DNA or synthetic DNA.

The term "gene" refers to a nucleic acid or fragment thereof that is capable of being expressed as a specific protein, optionally including regulatory sequences preceding (5' non-coding sequences) and following (3' non-coding sequences) the coding sequence.

As used herein, the term "coding region" refers to a DNA sequence that codes for a specific amino acid sequence. "Suitable regulatory sequences" refer to nucleotide sequences located upstream (5' non-coding sequences), within, or downstream (3' non-coding sequences) of a coding sequence and that influence the transcription, RNA processing or stability, or translation of the associated coding sequence. Regulatory sequences can include promoters, translation leader sequences, introns, polyadenylation recognition sequences, RNA processing site, effector binding site, and stem-loop structure.

As used herein, the terms "polypeptide" is intended to encompass a singular "polypeptide" as well as plural "polypeptides" and fragments thereof, and refers to a molecule composed of monomers (amino acids) linearly linked by amide bonds (also known as peptide bonds). The term "polypeptide" refers to any chain or chains of two or more amino acids, and does not refer to a specific length of the product. Thus, peptides, dipeptides, tripeptides, oligopeptides, protein, amino acid chain, or any other term used to refer to a chain or chains of two or more amino acids, are included within the definition of "polypeptide," and the term "polypeptide" can be used instead of, or interchangeably with any of these terms. A polypeptide can be derived from a natural biological source or produced by recombinant technology, but is not necessarily translated from a designated nucleic acid sequence. It can be generated in any manner, including by chemical synthesis.

By an "isolated" polypeptide or a fragment, variant, or derivative thereof is intended a polypeptide that is not in its natural milieu. No particular level of purification is required. For example, an isolated polypeptide can be removed from its native or natural environment. Recombinantly produced polypeptides and proteins expressed in host cells are considered isolated for purposes of the invention, as are native or recombinant polypeptides that have been separated, fractionated, or partially or substantially purified by any suitable technique.

As used herein, "native" refers to the form of a polynucleotide, gene or polypeptide as found in nature with its own regulatory sequences, if present.

As used herein, "endogenous" refers to the native form of a polynucleotide, gene or polypeptide in its natural location in the organism or in the genome of an organism. "Endogenous polynucleotide" includes a native polynucleotide in its natural location in the genome of an organism. "Endogenous gene" includes a native gene in its natural location in the genome of an organism. "Endogenous polypeptide" includes a native polypeptide in its natural location in the organism.

As used herein, "heterologous" refers to a polynucleotide, gene or polypeptide not normally found in the host organism but that is introduced into the host organism. "Heterologous polynucleotide" includes a native coding region, or portion thereof, that is reintroduced into the source organism in a form that is different from the corresponding native polynucleotide. "Heterologous gene" includes a native coding region, or portion thereof, that is reintroduced into the source organism in a form that is different from the corresponding native gene. For example, a heterologous gene can include a native coding region that is a portion of a chimeric gene including non-native regulatory regions that is reintroduced into the native host. "Heterologous polypeptide" includes a native polypeptide that is reintroduced into the source organism in a form that is different from the corresponding native polypeptide.

As used herein, the term "modification" refers to a change in a polynucleotide disclosed herein that results in reduced, substantially eliminated or eliminated activity of a polypeptide encoded by the polynucleotide, as well as a change in a polypeptide disclosed herein that results in reduced, substantially eliminated or eliminated activity of the polypeptide. Such changes can be made by methods well known in the art, including, but not limited to, deleting, mutating (e.g., spontaneous mutagenesis, random mutagenesis, mutagenesis caused by mutator genes, or transposon mutagenesis), substituting, inserting, down-regulating, altering the cellular location, altering the state of the polynucleotide or polypeptide (e.g., methylation, phosphorylation or ubiquitination), removing a cofactor, introduction of an antisense RNA/DNA, introduction of an interfering RNA/DNA, chemical modification, covalent modification, irradiation with UV or X-rays, homologous recombination, mitotic recombination, promoter replacement methods, and/or combinations thereof. Guidance in determining which nucleotides or amino acid residues can be modified, can be found by comparing the sequence of the particular polynucleotide or polypeptide with that of homologous polynucleotides or polypeptides, e.g., yeast or bacterial, and maximizing the number of modifications made in regions of high homology (conserved regions) or consensus sequences.

The term "derivative" as used herein, refers to a modification of a sequence disclosed in the present invention. Illustrative of such modifications would be the substitution, insertion, and/or deletion of one or more bases relating to a nucleic acid sequence of a coding sequence disclosed herein that preserve, slightly alter, or increase the function of a coding sequence disclosed herein in oil seed crop species. Such derivatives can be readily determined by one skilled in the art, for example, using computer modeling techniques for predicting and optimizing sequence structure. The term "derivative" thus also includes nucleic acid sequences having substantial sequence homology with the disclosed coding sequences herein such that they are able to have the disclosed functionalities for use in producing LC-PUFAs of the present invention.

As used herein, the term "variant" refers to a polypeptide differing from a specifically recited polypeptide of the invention by amino acid insertions, deletions, mutations, and substitutions, created using, e.g., recombinant DNA techniques, such as mutagenesis. Guidance in determining which amino acid residues can be replaced, added, or deleted without abolishing activities of interest, can be found by comparing the sequence of the particular polypeptide with that of homologous polypeptides and minimizing the number of amino acid sequence changes made in regions of high homology (conserved regions) or by replacing amino acids with consensus sequences.

Alternatively, recombinant polynucleotide variants encoding these same or similar polypeptides can be synthesized or selected by making use of the "redundancy" in the genetic code. Various codon substitutions, such as silent changes that produce various restriction sites, can be introduced to optimize cloning into a plasmid or viral vector for expression. Mutations in the polynucleotide sequence can be reflected in the polypeptide or domains of other peptides added to the polypeptide to modify the properties of any part of the polypeptide.

Amino acid "substitutions" can be the result of replacing one amino acid with another amino acid having similar structural and/or chemical properties, i.e., conservative amino acid replacements, or they can be the result of replacing one amino acid with an amino acid having different structural and/or chemical properties, i.e., non-conservative amino acid replacements. "Conservative" amino acid substitutions can be made on the basis of similarity in polarity, charge, solubility, hydrophobicity, hydrophilicity, or the amphipathic nature of the residues involved. For example, nonpolar (hydrophobic) amino acids include alanine, leucine, isoleucine, valine, proline, phenylalanine, tryptophan, and methionine; polar neutral amino acids include *glycine*, serine, threonine, cysteine, tyrosine, asparagine, and glutamine; positively charged (basic) amino acids include arginine, lysine, and histidine; and negatively charged (acidic) amino acids include aspartic acid and glutamic acid. Alternatively, "non-conservative" amino acid substitutions can be made by selecting the differences in polarity, charge, solubility, hydrophobicity, hydrophilicity, or the amphipathic nature of any of these amino acids. "Insertions" or "deletions" can be within the range of variation as structurally or functionally tolerated by the recombinant proteins. The variation allowed can be experimentally determined by systematically making insertions, deletions, or substitutions of amino acids in a polypeptide molecule using recombinant DNA techniques and assaying the resulting recombinant variants for activity.

The term "promoter" refers to a DNA sequence capable of controlling the expression of a coding sequence or functional RNA. In general, a coding sequence is located 3' to a promoter sequence. Promoters can be derived in their entirety from a native gene, or be composed of different elements derived from different promoters found in nature, or even comprise synthetic DNA segments. It is understood by those skilled in the art that different promoters can direct the expression of a gene in different tissues or cell types, or at different stages of development, or in response to different environmental or physiological conditions. Promoters that cause a gene to be expressed in most cell types at most times are commonly referred to as "constitutive promoters." It is further recognized that since in most cases the exact boundaries of regulatory sequences have not been completely defined, DNA fragments of different lengths can have identical promoter activity.

The term "operably linked" refers to the association of nucleic acid sequences on a single nucleic acid fragment so that the function of one is affected by the other. For example, a promoter is operably linked with a coding sequence when it is capable of affecting the expression of that coding sequence (e.g., that the coding sequence is under the transcriptional control of the promoter). Coding sequences can be operably linked to regulatory sequences in sense or antisense orientation.

The term "expression" as used herein, refers to the transcription and stable accumulation of sense (mRNA) or antisense RNA derived from the nucleic acid fragment of the invention. Expression can also refer to translation of mRNA into a polypeptide.

The term "overexpression" as used herein, refers to expression that is higher than endogenous expression of the same or related gene. A heterologous gene is overexpressed if its expression is higher than that of a comparable endogenous gene.

As used herein, the term "transformation" refers to the transfer of a nucleic acid or fragment into a host organism, resulting in genetically stable inheritance. Host organisms containing the transformed nucleic acid fragments are referred to as "transgenic" or "recombinant" or "transformed" organisms.

The terms "plasmid" and "vector" as used herein refer to an extra chromosomal element often carrying genes that are not part of the central metabolism of the cell, and usually in the form of circular double-stranded DNA molecules. Such elements can be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction that is capable of introducing a promoter fragment and DNA sequence for a selected gene product along with appropriate 3' untranslated sequence into a cell.

As used herein, the term "codon degeneracy" refers to the nature in the genetic code permitting variation of the nucleotide sequence without affecting the amino acid sequence of an encoded polypeptide. The skilled artisan is well aware of the "codon-bias" exhibited by a specific host cell in usage of nucleotide codons to specify a given amino acid. Therefore, when synthesizing a gene for improved expression in a host cell, it is desirable to design the gene such that its frequency of codon usage approaches the frequency of preferred codon usage of the host cell.

The term "codon-optimized" as it refers to genes or coding regions of nucleic acid molecules for transformation of various hosts refers to the alteration of codons in the gene or coding regions of the nucleic acid molecules to reflect the typical codon usage of the host organism without altering the polypeptide encoded by the DNA. Such optimization includes replacing at least one, more than one, or a significant number of codons with one or more codons that are more frequently used in the genes of that organism.

Deviations in the nucleotide sequence that comprise the codons encoding the amino acids of any polypeptide chain allow for variations in the sequence coding for the gene. Since each codon consists of three nucleotides, and the nucleotides comprising DNA are restricted to four specific bases, there are 64 possible combinations of nucleotides, 61 of which encode amino acids (the remaining three codons encode signals ending translation). The "genetic code" that shows which codons encode which amino acids are reproduced herein in the table below. As a result, many amino acids are designated by more than one codon. For example, the amino acids alanine and proline are coded for by four triplets, serine and arginine by six, whereas tryptophan and methionine are coded by just one triplet. This degeneracy allows for DNA base composition to vary over a wide range without altering the amino acid sequence of the proteins encoded by the DNA.

| The Standard Genetic Code | | | | |
|---|---|---|---|---|
| | T | C | A | G |
| T | TTT Phe (F) | TCT Ser (S) | TAT Tyr (Y) | TGT Cys (C) |
| | TTC" | TCC" | TAC" | TGC |
| | TTA Leu (L) | TCA" | TAA Stop | TGA Stop |
| | TTG" | TCG" | TAG Stop | TGG Trp (W) |
| C | CTT Leu (L) | CCT Pro (P) | CAT His (H) | CGT Arg (R) |
| | CTC" | CCC" | CAC" | CGC" |
| | CTA" | CCA" | CAA Gln (Q) | CGA" |
| | CTG" | CCG" | CAG" | CGG" |
| A | ATT Ile (I) | ACT Thr (T) | AAT Asn (N) | AGT Ser (S) |
| | ATC" | ACC" | AAC" | AGC" |
| | ATA" | ACA" | AAA Lys (K) | AGA Arg (R) |
| | ATG Met (M) | ACG" | AAG" | AGG" |
| G | GTT Val (V) | GCT Ala (A) | GAT Asp (D) | GGT Gly (G) |
| | GTC" | GCC" | GAC" | GGC" |
| | GTA" | GCA" | GAA Glu (E) | GGA" |
| | GTG" | GCG" | GAG" | GGG" |

Many organisms display a bias for use of particular codons to code for insertion of a particular amino acid in a growing peptide chain. Codon preference, or codon bias, differences in codon usage between organisms, is afforded by degeneracy of the genetic code, and is well documented among many organisms. Codon bias often correlates with the efficiency of translation of messenger RNA (mRNA), which is in turn believed to be dependent on, inter alia, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization.

Given the large number of gene sequences available for a wide variety of animal, plant and microbial species, it is possible to calculate the relative frequencies of codon usage. Codon usage tables are readily available and can be adapted in a number of ways. See Nakamura et al., *Nucl. Acids Res.* 28:292 (2000). By utilizing this or similar tables, one of ordinary skill in the art can apply the frequencies to any given polypeptide sequence, and produce a nucleic acid fragment of a codon-optimized coding region that encodes the polypeptide, but uses codons optimal for a given species. The present invention pertains to codon optimized forms of OrfA, OrfB, chimeric OrfC, PPTase and/or other accessory proteins of the invention, as described further herein.

The term "percent identity" as known in the art, is a relationship between two or more polypeptide sequences or two or more polynucleotide sequences, as determined by comparing the sequences. In the art, "identity" also means the degree of sequence relatedness between polypeptide or polynucleotide sequences, as the case can be, as determined by the match between strings of such sequences. "Identity"

and "similarity" can be readily calculated by known methods, including but not limited to those disclosed in: 1) Computational Molecular Biology (A. M. Lesk, Ed.) Oxford University: NY (1988); 2) Biocomputing: Informatics and Genome Projects (D. W. Smith, Ed.) Academic: NY (1993); 3) Computer Analysis of Sequence Data, Part I (A. M. Griffin and H. G. Griffin, Eds.) Humania: NJ (1994); 4) Sequence Analysis in Molecular Biology (G. von Heinje, Ed.) Academic (1987); and 5) Sequence Analysis Primer (M. Gribskov and J. Devereux, Eds.) Stockton: NY (1991).

Methods to determine identity are designed to give the best match between the sequences tested. Methods to determine identity and similarity are codified in publicly available computer programs. Sequence alignments and percent identity calculations can be performed, for example, using the AlignX program of the Vector NTI® suite (Invitrogen, Carlsbad, Calif.) or MEGALIGN™ program of the LASERGENE® bioinformatics computing suite (DNASTAR, Inc., Madison, Wis.). Multiple alignment of the sequences is performed using the "Clustal method of alignment," which encompasses several varieties of the algorithm including the "Clustal V method of alignment" corresponding to the alignment method labeled Clustal V (disclosed by Higgins and Sharp, CABIOS. 5:151-153 (1989); D. G. Higgins, et al., Comput. Appl. Biosci., 8:189-191 (1992)) and found in the MEGALIGN™ program of the LASERGENE® bioinformatics computing suite (DNASTAR, Inc.). For multiple alignments, the default values correspond to GAP PENALTY=10 and GAP LENGTH PEN ALT Y=10. Default parameters for pairwise alignments and calculation of percent identity of protein sequences using the Clustal method are KTUPLE-T, GAP PENALTY=3, WTNDOW=5 and DIAGONALS SAVED=5. For nucleic acids these parameters are KTUPLE-2, GAP PENALTY-5, WINDOW=4 and DIAGONALS SAVED=4. After alignment of the sequences using the Clustal V program, it is possible to obtain a "percent identity" by viewing the "sequence distances" table in the same program. Additionally the "Clustal W method of alignment" is available and corresponds to the alignment method labeled Clustal W (described by Higgins and Sharp, CABIOS. 5:151-153 (1989); D. G. Higgins, et al., Comput. Appl. Biosci. 8:189-191 (1992)) and found in the MEGALIGN™ v6.1 program of the LASERGENE® bioinformatics computing suite (DNASTAR, Inc.). Default parameters for multiple alignment (GAP PENALTY™ 10, GAP LENGTH PENALTY=0.2, Delay Divergen Seqs(%)=30, DNA Transition Weight=0.5, Protein Weight Matrix=Gonnet Series, DNA Weight Matrix=IUB). After alignment of the sequences using the Clustal W program, it is possible to obtain a "percent identity" by viewing the "sequence distances" table in the same program.

The term "sequence analysis software" refers to any computer algorithm or software program that is useful for the analysis of nucleotide or amino acid sequences. "Sequence analysis software" can be commercially available or independently developed. Typical sequence analysis software will include, but is not limited to: 1.) the GCG suite of programs (Wisconsin Package Version 9.0, Genetics Computer Group (GCG), Madison, Wis.); 2.) BLASTP, BLASTN, BLASTX (Altschul et al., J. Mol. Biol., 215:403-410 (1990)); 3.) DNASTAR® (DNASTAR, Inc. Madison, Wis.); 4.) SEQUENCHER® (Gene Codes Corporation, Ann Arbor, Mich.); and 5.) the FASTA program incorporating the Smith-Waterman algorithm (W. R. Pearson, Comput. Methods Genome Res., [Proc. Int. Symp.] (1994), Meeting Date 1992, 11 1-20. Editor(s): Suhai, Sandor. Plenum: New York, N.Y.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

Standard recombinant DNA and molecular cloning techniques used here are well known in the art and are described, e.g., by Sambrook et al., Molecular Cloning: A Laboratory Manual, Third Edition, Cold Spring Harbor Laboratory Press, Cold Spring Harbor, N.Y. (2000); and by Silhavy et al., Experiments with Gene Fusions, Cold Spring Harbor Laboratory Press, Cold Spring Harbor, N.Y. (1984); and by Ausubel et al., Current Protocols in Molecular Biology, published by Greene Publishing Assoc. and Wiley-Interscience (1987 to present).

The genetic manipulations of a recombinant hosts disclosed herein can be performed using standard genetic techniques and screening and can be made in any host cell that is suitable to genetic manipulation. In some embodiments, a recombinant host can be, but is not limited to, any higher plant, including both dicotyledonous and monocotyledonous plants, and consumable plants, including crop plants and plants used for their oils. Thus, any plant species or plant cell can be selected as described further below.

The oils of the present invention can also be used in non-culinary or dietary processes and compositions. Some of these uses can be industrial, cosmetic or medical. Oils of the present invention can also be used in any application for which the oils of the present invention are suited. In general, the oils of the present invention can be used to replace, e.g., mineral oils, esters, fatty acids, or animal fats in a variety of applications, such as lubricants, lubricant additives, metal working fluids, hydraulic fluids and fire resistant hydraulic fluids. The oils of the present invention can also be used as materials in a process of producing modified oils. Examples of techniques for modifying oils of the present invention include fractionation, hydrogenation, alteration of the oil's oleic acid or linolenic acid content, and other modification techniques known to those of skill in the art.

Examples of cosmetic uses for oils of the present invention include use as an emollient in a cosmetic composition; as a petroleum jelly replacement; as comprising part of a soap, or as a material in a process for producing soap; as comprising part of an oral treatment solution; as comprising part of an ageing treatment composition; and as comprising part of a skin or hair aerosol foam preparation.

Additionally, the oils of the present invention can be used in medical applications. For example, oils of the present invention can be used in a protective barrier against infection, and oils high in omega-9 fatty acids can be used to enhance transplant graft survival (U.S. Pat. No. 6,210,700).

It should be understood that the foregoing are non-limiting examples of non-culinary uses for which the oils of the present invention are suited. As previously stated, oils and modified oils of the present invention can be used to replace, e.g., mineral oils, esters, fatty acids, or animal fats in all applications known to those of skill in the art.

PUFA Synthase

The "standard" or "classical" pathway for synthesis of long chain PUFAs (LC-PUFAs) in eukaryotic organisms involves the elongation and desaturation of medium chain-length saturated or mono-unsaturated fatty acids and has been described. The pathway for synthesis of long chain PUFAs via a PUFA synthase has also been described and is very different from the "standard" pathway. Specifically, PUFA synthases utilize malonyl-CoA as a carbon source and produce the final PUFA without releasing intermediates in any significant amount. Also, with PUFA synthases, the appropriate cis double bonds are added during the synthesis using a mechanism that does not require oxygen. In some embodiments, NADPH is used as a reductant during the synthesis cycles.

The present invention relates to host organisms (e.g., plants such as soybean) that have been genetically modified to express a PUFA synthase (either endogenously or by genetic manipulation). In some embodiments, an organism that has been genetically modified to express a PUFA synthase, wherein the organism does not naturally (endogenously, without genetic modification) express such an enzyme, or at least that particular PUFA synthase or portion thereof with which the organism is being genetically modified, can be referred to herein as a "heterologous" host organism with regard to the modification of the organism with the PUFA synthase or with another protein that is not endogenously expressed by the organism. The genetic modifications of the present invention can be used to improve PUFA production in a host organism that endogenously expresses a PUFA synthase, where the organism is not further modified with a different PUFA synthase or a portion thereof.

A PUFA synthase according to the present invention can comprise several multifunctional proteins (and can include single function proteins, particularly for PUFA synthase from marine bacteria) that can act together to conduct both iterative processing of the fatty acid chain as well as non-iterative processing, including trans-cis isomerization and enoyl reduction reactions in selected cycles. These proteins can also be referred to herein as the core PUFA synthase enzyme complex or the core PUFA synthase. The general functions of the domains and motifs contained within these proteins are individually known in the art and have been described in detail with regard to various PUFA synthases from marine bacteria and eukaryotic organisms (see, e.g., U.S. Pat. Nos. 6,140,486; 6,566,583; Metz et al., Science 293:290-293 (2001); U.S. Appl. Pub. No. 2002/0194641, now U.S. Pat. No. 7,247,461, issued Jul. 24, 2007; U.S. Appl. Pub. No. 2004/0235127, now U.S. Pat. No. 7,211,418, issued May 1, 2007; U.S. Appl. Pub. No. 2005/0100995, now U.S. Pat. No. 7,217,856, issued May 15, 2007; and WO 2006/135866). The domains can be found as a single protein (e.g., the domain and protein are synonymous) or as one of two or more (multiple) domains in a single protein, as mentioned above. The domain architecture of various PUFA synthases from marine bacteria and members of *Thraustochytrium*, and the structural and functional characteristics of genes and proteins comprising such PUFA synthases, have been described (see, e.g., U.S. Pat. Nos. 6,140,486; 6,566,583; Metz et al., Science 293:290-293 (2001); U.S. Appl. Pub. No. 2002/0194641, now U.S. Pat. No. 7,247,461, issued Jul. 24, 2007; U.S. Appl. Pub. No. 2004/0235127, now U.S. Pat. No. 7,211,418, issued May 1, 2007; U.S. Appl. Pub. No. 2005/0100995, now U.S. Pat. No. 7,217,856, issued May 15, 2007; and WO 2006/135866).

Numerous examples of polynucleotides, genes and polypeptides having PUFA synthase activity are known in the art and can be used in a genetically modified host disclosed herein. PUFA synthase proteins or domains that are useful in the present invention can include both bacterial and non-bacterial PUFA synthases. A non-bacterial PUFA synthase is a system that is from or derived from an organism that is not a bacterium, such as a eukaryote. Bacterial PUFA synthases are described, for example, in U.S. Appl. Pub. No. 2008/0050505, now U.S. Pat. No. 7,868,228, issued Jan. 11, 2011.

Genetically modified plants of the invention can be produced that incorporate non-bacterial PUFA synthase functional domains with bacterial PUFA synthase functional domains, as well as PUFA synthase functional domains or proteins from other PKS systems (Type I iterative or modular, Type II, or Type III) or FAS systems.

In some embodiments, a PUFA synthase of the present invention comprises at least the following biologically active domains that are typically contained on three, four, or more proteins: (a) at least one enoyl-ACP reductase (ER) domain; (b) multiple acyl carrier protein (ACP) domain(s) (e.g., at least from one to four, or at least five ACP domains, and in some embodiments up to six, seven, eight, nine, ten, or more than ten ACP domains); (c) at least two β-ketoacyl-ACP synthase (KS) domains; (d) at least one acyltransferase (AT) domain; (e) at least one β-ketoacyl-ACP reductase (KR) domain; (f) at least two FabA-like β-hydroxyacyl-ACP dehydrase (DH) domains; (g) at least one chain length factor (CLF) domain; and/or (h) at least one malonyl-CoA:ACP acyltransferase (MAT) domain. In some embodiments, a PUFA synthase according to the present invention also comprises at least one region containing a dehydratase (DH) conserved active site motif.

In some embodiments, a PUFA synthase comprises at least the following biologically active domains: (a) at least one enoyl-ACP reductase (ER) domain; (b) at least five acyl carrier protein (ACP) domains; (c) at least two β-ketoacyl-ACP synthase (KS) domains; (d) at least one acyltransferase (AT) domain; (e) at least one β-ketoacyl-ACP reductase (KR) domain; (f) at least two FabA-like β-hydroxyacyl-ACP dehydrase (DH) domains; (g) at least one chain length factor (CLF) domain; and (h) at least one malonyl-CoA:ACP acyltransferase (MAT) domain. In some embodiments, a PUFA synthase according to the present invention also comprises at least one region or domain containing a dehydratase (DH) conserved active site motif that is not a part of a FabA-like DH domain. The structural and functional characteristics of each of these domains are described in detail in U.S. Appl. Pub. No. 2002/0194641, now U.S. Pat. No. 7,247,461, issued Jul. 24, 2007; U.S. Appl. Pub. No. 2004/0235127, now U.S. Pat. No. 7,211,418, issued May 1, 2007; U.S. Appl. Pub. No. 2005/0100995, now U.S. Pat. No. 7,217,856, issued May 15, 2007; U.S. Appl. Pub. No. 2007/0245431; and WO 2006/135866.

There are three open reading frames that form the core *Schizochytrium* PUFA synthase and that have been described previously, e.g., in U.S. Appl. Pub. No. 2007/0245431. The domain structure of each open reading frame is as follows.

*Schizochytrium* Open Reading Frame A (OrfA or Pfa1):

OrfA is a 8730 nucleotide sequence (not including the stop codon) that encodes a 2910 amino acid sequence. Within OrfA, there are twelve domains: (a) one β-keto acyl-ACP synthase (KS) domain; (b) one malonyl-CoA:ACP acyltransferase (MAT) domain; (c) nine acyl carrier protein (ACP) domains; and (d) one ketoreductase (KR) domain. Genomic DNA clones (plasmids) encoding OrfA from both *Schizochytrium* sp. ATCC 20888 and a daughter strain of ATCC 20888, denoted *Schizochytrium* sp., strain N230D, have been isolated and sequenced.

Genomic clone pJK1126 (denoted pJK1126 OrfA genomic clone, in the form of an *E. coli* plasmid vector containing "OrfA" gene from *Schizochytrium* ATCC 20888) was deposited with the American Type Culture Collection (ATCC), 10801 University Boulevard, Manassas, Va. 201 10-2209 USA on Jun. 8, 2006, and assigned ATCC Accession No. PTA-7648.

Genomic clone pJK306 (denoted pJK306 OrfA genomic clone, in the form of an *E. coli* plasmid containing 5' portion of OrfA gene from *Schizochytrium* sp. N230D (2.2 kB overlap with pJK320)) was deposited with the American Type Culture Collection (ATCC), 10801 University Boulevard, Manassas, Va. 20110-2209 USA on Jun. 8, 2006, and assigned ATCC Accession No. PTA-7641.

Genomic clone pJK320 (denoted pJK320 OrfA genomic clone, in the form of an *E. coli* plasmid containing 3' portion of OrfA gene from *Schizochytrium* sp. N230D (2.2 kB overlap with pJK306)) was deposited with the American Type Culture Collection (ATCC), 10801 University Boulevard, Manassas, Va. 201 10-2209 USA on Jun. 8, 2006, and assigned ATCC Accession No. PTA-7644.

*Schizochytrium* Open Reading Frame B (OrfB or Pfa2):

OrfB is a 6177 nucleotide sequence (not including the stop codon) that encodes a 2059 amino acid sequence. Within OrfB, there are four domains: (a) one-keto acyl-ACP synthase (KS) domain; (b) one chain length factor (CLF) domain; (c) one acyl transferase (AT) domain; and, (d) one enoyl ACP-reductase (ER) domain. Genomic DNA clones (plasmids) encoding OrfB from both *Schizochytrium* sp. ATCC 20888 and a daughter strain of ATCC 20888, denoted *Schizochytrium* sp., strain N230D, have been isolated and sequenced.

Genomic clone pJK1129 (denoted pJK1129 OrfB genomic clone, in the form of an *E. coli* plasmid vector containing "OrfB" gene from *Schizochytrium* ATCC 20888) was deposited with the American Type Culture Collection (ATCC), 10801 University Boulevard, Manassas, Va. 20110-2209 USA on Jun. 8, 2006, and assigned ATCC Accession No. PTA-7649.

Genomic clone pJK324 (denoted pJK324 OrfB genomic clone, in the form of an *E. coli* plasmid containing the OrfB gene sequence from *Schizochytrium* sp. N230D) was deposited with the American Type Culture Collection (ATCC), 10801 University Boulevard, Manassas, Va. 20110-2209 USA on Jun. 8, 2006, and assigned ATCC Accession No. PTA-7643.

*Schizochytrium* Open Reading Frame C (OrfC or Pfa3):

OrfC is a 4506 nucleotide sequence (not including the stop codon) that encodes a 1502 amino acid sequence. Within OrfC, there are three domains: (a) two FabA-like-hydroxy acyl-ACP dehydrase (DH) domains; and (b) one enoyl ACP-reductase (ER) domain. Genomic DNA clones (plasmids) encoding OrfC from both *Schizochytrium* sp. ATCC 20888 and a daughter strain of ATCC 20888, denoted *Schizochytrium* sp., strain N230D, have been isolated and sequenced.

Genomic clone pJK1131 (denoted pJK1131 OrfC genomic clone, in the form of an *E. coli* plasmid vector containing "OrfC" gene from *Schizochytrium* ATCC 20888) was deposited with the American Type Culture Collection (ATCC), 10801 University Boulevard, Manassas, Va. 201 10-2209 USA on Jun. 8, 2006, and assigned ATCC Accession No. PTA-7650.

Genomic clone pBR002 (denoted pBR002 OrfC genomic clone, in the form of an *E. coli* plasmid vector containing the OrfC gene sequence from *Schizochytrium* sp. N230D) was deposited with the American Type Culture Collection (ATCC), 10801 University Boulevard, Manassas, Va. 20110-2209 USA on Jun. 8, 2006, and assigned ATCC Accession No. PTA-7642.

In addition, there are three open reading frames that form the core *Thraustochytrium* PUFA synthase that have been described previously. The domain structure of each open reading frame is as follows.

*Thraustochytrium* 23 Open Reading Frame A (OrfA):

OrfA is a 8433 nucleotide sequence (not including the stop codon) that encodes a 281 1 amino acid sequence. The following domains are present in Th. 23B OrfA: (a) one β-ketoacyl-ACP synthase (KS) domain; (b) one malonyl-CoA:ACP acyltransferase (MAT) domain; (c) eight acyl earner protein (ACP) domains; and (d) one β-ketoacyl-ACP reductase (R) domain.

Genomic clone Th23BOrfA_pBR812.1 (denoted Th23BOrfA_pBR812.1 genomic clone, in the form of an *E. coli* plasmid vector containing the OrfA gene sequence from *Thraustochytrium* 23 B) was deposited with the American Type Culture Collection (ATCC), University Boulevard, Manassas, Va. 201 10-2209 USA on Mar. 1, 2007, and assigned ATCC Accession No. PTA-8232. Genomic clone Th23BOrfA_pBR811 (denoted Th23BOrfA_pBR811 genomic clone, in the form of an *E. coli* plasmid vector containing the OrfA gene sequence from *Thraustochytrium* 23B) was deposited with the American Type Culture Collection (ATCC), 10801 University Boulevard, Manassas, Va. 201 10-2209 USA on Mar. 1, 2007, and assigned ATCC Accession No. PTA-8231.

*Thraustochytrium* 23B Open Reading Frame B (OrfB):

OrfB is a 5805 nucleotide sequence (not including the stop codon) that encodes a 1935 amino acid sequence. The following domains are present in Th. 23B OrfB: (a) one β-ketoacyl-ACP synthase (KS) domain; (b) one chain length factor (CLF) domain; (c) one acyltransferase (AT) domain; and, (d) one enoyl-ACP reductase (ER) domain. Genomic clone Th23BOrfB_pBR800 (denoted Th23BOrfB_pBR800 genomic clone, in the form of an *E. coli* plasmid vector containing the OrfB gene sequence from *Thraustochytrium* 23 B) was deposited with the American Type Culture Collection (ATCC), 10801 University Boulevard, Manassas, Va. 20110-2209 USA on Mar. 1, 2007, and assigned ATCC Accession No. PTA-8227.

*Thraustochytrium* 23B Open Reading Frame C (OrfC):

OrfC is a 4410 nucleotide sequence (not including the stop codon) that encodes a 1470 amino acid sequence. The following domains are present in Th. 23B OrfC: (a) two FabA-like β-hydroxyacyl-ACP dehydrase (DH) domains, both with homology to the FabA protein (an enzyme that catalyzes the synthesis of trans-2-decenoyl-ACP and the reversible isomerization of this product to cis-3-decenoyl-ACP); and (b) one enoyl-ACP reductase (ER) domain with high homology to the ER domain of *Schizochytrium* OrfB. Genomic clone Th23BOrfC_pBR709A (denoted Th23BOrfC_pBR709A genomic clone, in the form of an *E. coli* plasmid vector containing the OrfC gene sequence from *Thraustochytrium* 23B) was deposited with the American Type Culture Collection (ATCC), 10801 University Boulevard, Manassas, Va. 201 10-2209 USA on Mar. 1, 2007, and assigned ATCC Accession No. PTA-8228.

Chimeric or Hybrid PUFA Synthase:

In some embodiments, the PUFA synthase comprises domains selected from any of those described herein, wherein the domains are combined (e.g., mixed and matched) to form a complete PUFA synthase meeting the minimum requirements described herein. In some embodiments, the genetically modified organism of the invention can be further modified with at least one domain or biologically active fragment thereof of another PUFA synthase. In some embodiments, any of the domains of a PUFA synthase can be modified from their natural structure to modify or enhance the function of that domain in the PUFA synthase system (e.g., to modify the PUFA types or ratios thereof produced by the system). Such mixing of domains to produce chimeric PUFA synthase is described in the patents and publications referenced herein.

In some embodiments, the PUFA synthase comprises a *Schizochytrium* PUFA synthase wherein OrfC from the *Schizochytrium* PUFA synthase is replaced with OrfC from *Thraustochytrium* 23B. In some embodiments, such a chimeric OrfC from *Thraustochytrium* 23B is encoded by a nucleic acid sequence that is optimized for *Schizochytrium* codon usage. As a non-limiting example of such a chimeric OrfC, plasmid pThOrfC-synPS (denoted pThOrfC-synPS, in the form of an *E. coli* plasmid vector containing a "perfect stitch" synthetic *Thraustochytrium* 23 B PUFA PKS OrfC codon optimized for expression in *Schizochytrium* or other heterologous hosts) was deposited with the American Type Culture Collection (ATCC), 10801 University Boulevard, Manassas, Va. 201 10-2209 USA on Mar. 1, 2007, and assigned ATCC Accession No. PTA-8229 (see also U.S. Appl. Pub. No. 2008/0022422, now U.S. Pat. No. 8,003,772, issued Aug. 23, 2011).

Other examples of PUFA synthase genes and polypeptides that can be used in a genetically modified organism of the invention include, but are not limited to, the following codon-optimized sequences generated by the methods described further herein: SEQ ID NO:1 (SzPUFA OrfA v3 protein); SEQ ID NO:2 (SzPUFA OrfB v3 protein); SEQ ID NO:3 (hSzThPUFA OrfC v3 protein); SEQ ID NO:6 (SzPUFA OrfA gene); SEQ ID NO:7 (SzPUFA OrfB v3 gene); and SEQ ID NO:8 (hSzThPUFA OrfC v3 gene), as well as an active variant, portion, fragment, or derivative of such sequences, wherein such a gene encodes, or such a polypeptide or protein has, PUFA synthase activity. The present invention includes an isolated polynucleotide or polypeptide comprising or consisting of one or more of such sequences.

Other examples of PUFA synthase genes and polypeptides that can be used in the invention include, but are not limited to, PUFA synthase genes or polypeptides having at least 80%, at least 85%, at least 90%, at least 95%, at least 96%, at least 97%, at least 98%, at least 99% or 100% sequence identity to any one of the PUFA synthase genes or polypeptides described herein. Useful ranges can be selected between any of these values (for example, 80% to 100% identical, 85% to 100% identical, 90% to 100% identical, 95% to 100% identical, 80% to 99% identical, 85% to 99% identical, 90% to 99% identical, or 95% to 99% identical). Still other examples of PUFA synthase genes and polypeptides that can used in a genetically modified organism of the invention include, but are not limited to an active variant, portion, fragment of derivative of any one of the PUFA synthases or sequences described herein, wherein such a gene encodes, or such a polypeptide has, PUFA synthase activity.

In some embodiments, the PUFA synthase can be an algal PUFA synthase. In some embodiments, the PUFA synthase can comprise an amino acid sequence that is 80% to 100% identical, 85% to 100% identical, 90% to 100% identical, 95% to 100% identical, 80% to 99% identical, 85% to 99% identical, 90% to 99% identical, or 95% to 99% identical to the amino acid sequence of SEQ ID NO: 1. In some embodiments, the PUFA synthase can comprise the amino acid sequence of SEQ ID NO: 1. In some embodiments, the nucleic acid sequence encoding the PUFA synthase can comprise a nucleic acid sequence 80% to 100% identical, 85% to 100% identical, 90% to 100% identical, 95% to 100% identical, 80% to 99% identical, 85% to 99% identical, 90% to 99% identical, or 95% to 99% identical to the nucleic acid sequence of SEQ ID NO:6. In some embodiments, the nucleic acid sequence encoding the PUFA synthase can comprise the nucleic acid sequence of SEQ ID NO:6. In some embodiments, the PUFA synthase can comprise an amino acid sequence that is at least 80%, at least 85%, at least 90%, at least 95%, at least 96%, at least 97%, at least 98%, or at least 99% identical to the amino acid sequence of SEQ ID NO:2. In some embodiments, the PUFA synthase can comprise the amino acid sequence of SEQ ID NO:2. In some embodiments, the nucleic acid sequence encoding the PUFA synthase can comprise a nucleic acid sequence that is at least 80%, at least 85%, at least 90%, at least 95%, at least 96%, at least 97%, at least 98%, or at least 99% identical to the nucleic acid sequence of SEQ ID NO:7. in some embodiments, the nucleic acid sequence encoding the PUFA synthase can comprise the nucleic acid sequence of SEQ ID NO:7. In some embodiments, the PUFA synthase can comprise an amino acid sequence that is at least 80%, at least 85%, at least 90%, at least 95%, at least 96%, at least 97%, at least 98%, or at least 99% identical to the amino acid sequence of SEQ ID NO:3. In some embodiments, the PUFA synthase comprises the amino acid sequence of SEQ ID NO:3. In some embodiments, the nucleic acid sequence encoding the PUFA synthase comprises a nucleic acid sequence that is at least 80%, at least 85%, at least 90%, at least 95%, at least 96%, at least 97%, at least 98%, or at least 99% identical to the nucleic acid sequence of SEQ ID NO:8. In some embodiments, the nucleic acid sequence encoding the PUFA synthase comprises the nucleic acid sequence of SEQ ID NO:8.

In some embodiments, the PUFA synthase comprises the amino acid sequence of SEQ ID NO:1, 2, or 3 or any combinations thereof. In some embodiments, the PUFA synthase comprises the nucleic acid sequence of SEQ ID NO:6, 7, or 8 or any combinations thereof. In some embodiments, the nucleic acid sequence encodes an amino acid sequence of SEQ ID NO:1, 2, or 3, or any combinations or percent identities thereof described herein.

In some embodiments, the sequences of other PUFA synthase genes and/or polypeptides can be identified in the literature and in bioinformatics databases well known to the skilled person using sequences disclosed herein and available in the art. For example, such sequences can be identified through BLAST searching of publicly available databases with known PUFA synthase gene or polypeptide sequences. In such a method, identities can be based on the Clustal W method of alignment using the default parameters of GAP PEN ALT Y=10, GAP LENGTH PENALTY-0.1, and Gonnet 250 series of protein weight matrix.

Additionally, the PUFA synthase gene or polypeptide sequences disclosed herein or known the art can be used to identify other PUFA synthase homologs in nature. For example, each of the PUFA synthase nucleic acid fragments disclosed herein can be used to isolate genes encoding homologous proteins. Isolation of homologous genes using sequence-dependent protocols is well known in the art. Examples of sequence-dependent protocols include, but are not limited to (1) methods of nucleic acid hybridization; (2) methods of DNA and RNA amplification, as exemplified by various uses of nucleic acid amplification technologies (e.g., polymerase chain reaction (PCR), Mullis et al., U.S. Pat. No. 4,683,202; ligase chain reaction (LCR), S. Tabor, et al., Proc. Acad. Sci. USA 82:1074 (1985); or strand displacement amplification (SDA), Walker et al., Proc. Natl. Acad. Sci. U.S.A., 89:392 (1992)); and (3) methods of library construction and screening by complementation.

All of these methods can be readily practiced by one skilled in the art making use of the known or identified sequences encoding target proteins. In some embodiments, DNA sequences surrounding a target PUFA synthase coding sequence are also useful in some modification procedures and can be readily found by one of skill in the art in publicly available databases. Methods for creating genetic mutations are common and well known in the art and can be applied to the exercise of creating mutants.

Phosphopantethienyl Transferase

The phosphopantethienyl transferases (PPTases) are a family of enzymes that have been well characterized in fatty acid synthesis, polyketide synthesis, and non-ribosomal peptide synthesis. In particular, the ACP domains present in the PUFA synthase enzymes require activation by attachment of a cofactor (4-phosphopantetheine) from coenzyme A to the acyl carrier protein (ACP). Attachment of this cofactor is carried out by PPTases. If the endogenous PPTases of the host organism are incapable of activating the PUFA synthase ACP domains, then it is necessary to provide a PPTase that is capable of carrying out that function. The sequences of many PPTases are known, and crystal structures have been determined (e.g., Reuter et al., EMBO J. 18:6823-31 (1999)) as well as mutational analysis of amino acid residues important for activity (Mofid et al., Biochemistry 43:4128-36 (2004)).

One example of a heterologous PPTase that has been demonstrated previously to recognize the OrfA ACP domains described herein as substrates is the Het I protein of *Nostoc* sp. PCC 7120 (formerly called *Anabaena* sp. PCC 7120). Het I is present in a cluster of genes in *Nostoc* known to be responsible for the synthesis of long chain hydroxy-fatty acids that are a component of a glyco-lipid layer present in heterocysts of that organism (Black and Wolk, *J. Bacteriol.* 775:2282-2292 (1994); Campbell et al., *Arch. Microbiol.* 7(57:251-258 (1997)). Het I is likely to activate the ACP domains of a protein, Hgl E, present in that cluster. The two ACP domains of Hgl E have a high degree of sequence homology to the ACP domains found in *Schizochytrium* Orf A and other PUFA synthases.

In some embodiments, a PUFA synthase can be considered to include at least one 4'-phosphopantetheinyl transferase (PPTase) domain, or such a domain can be considered to be an accessory domain or protein to the PUFA synthase. Structural and functional characteristics of PPTases have been described in detail, for example, in U.S. Appl. Pub. No. 2002/0194641, now U.S. Pat. No. 7,247,461, issued Jul. 24, 2007; U.S. Appl. Pub. No. 2004/0235127, now U.S. Pat. No. 7,211,418, issued May 1, 2007; and U.S. Appl. Pub. No. 2005/0100995, now U.S. Pat. No. 7,217,856, issued May 15, 2007.

Numerous examples of genes and polypeptides having PPTase activity are known in the art and could be used in a genetically modified organism of the invention if they are capable of activating the ACP domains of the particular PUFA synthase being used. Examples of genes and polypeptides that can be used in a genetically modified organism of the invention can include, but are not limited to, the following codon-optimized sequences described further herein: SEQ ID NO:5 (NoHetI v3 protein) and SEQ ID NO:10 (NoHetI v3 gene).

Other examples of PPTase genes and polypeptides that can be used in a genetically modified organism of the invention include, but are not limited to, PPTase genes or polypeptides having at least 80%, at least 85%, at least 90%, at least 95%, at least 96%, at least 97%, at least 98%, at least 99% or 100% sequence identity to any one of the PPTases or sequences described herein. Useful ranges can be selected between any of these values (for example, 80% to 100% identical, 85% to 100% identical, 90% to 100% identical, 95% to 100% identical, 80% to 99% identical, 85% to 99% identical, 90% to 99% identical, or 95% to 99% identical). Still other examples of PPTase genes and polypeptides that can used in a genetically modified organism of the invention include, but are not limited to an active variant, fragment, portion or derivative of any one of the PPTase sequences described herein, wherein such a gene encodes, or such a polypeptide has, PPTase activity.

In some embodiments, the PPTase can be an algal PPTase. In some embodiments, the PPTase can comprise an amino acid sequence that is 80% to 100% identical, 85%» to 100% identical, 90% to 100% identical, 95% to 100% identical, 80% to 99% identical, 85% to 99% identical, 90% to 99% identical, or 95% to 99% identical to the amino acid sequence of SEQ ID NO:5. In some embodiments, the PPTase can comprise the amino acid sequence of SEQ ID NO:5. In some embodiments, the nucleic acid sequence encoding the PPTase can comprise a nucleic acid sequence 80% to 100% identical, 85% to 100% identical, 90% to 100% identical, 95% to 100% identical, 80% to 99% identical, 85% to 99% identical, 90% to 99% identical, or 95% to 99% identical to the nucleic acid sequence of SEQ ID NO:10. In some embodiments, the nucleic acid sequence encoding the PPTase can comprise the nucleic acid sequence of SEQ ID NO:10. In some embodiments, the nucleic acid sequence encodes an amino acid sequence of SEQ ID NO:5 or any percent identities thereof described herein.

In some embodiments of the present invention, a PPTase can be provided for production and/or accumulation of PPTase in a heterologous host.

In some embodiments, a gene and/or polypeptide encoding PPTase can be used to identify another PPTase gene and/or polypeptide sequences and/or can be used to identify a PPTase homolog in other cells. Such PPTase encoding sequences can be identified, for example, in the literature and/or in bioinformatics databases well known to the skilled person. For example, the identification of a PPTase encoding sequence in another cell type using bioinformatics can be accomplished through BLAST (as disclosed above) searching of publicly available databases with a known PPTase encoding DNA and polypeptide sequence, such as any of those provided herein. Identities are based on the Clustal W method of alignment using the default parameters of GAP PENALTY=10, GAP LENGTH PENALTY=0.1, and Gonnet 250 series of protein weight matrix.

In some embodiments, the genetically modified plant (e.g., soybean), descendant, cell, tissue, or part thereof contains a PUFA synthase and a PPTase. In some embodiments, the genetically modified plant (e.g., soybean), descendant, cell, tissue, or part thereof contains the nucleic acid sequences of (i) and (ii) in a single recombinant expression vector. In some embodiments, the genetically modified plant (e.g., soybean), descendant, cell, tissue, or part thereof contains the nucleic acid sequences of (i) and (ii) in different recombinant expression vectors.

Acyl-CoA Synthetase

The present invention provides acyl-CoA synthetase (ACoAS) proteins that catalyze the conversion of long chain PUFA free fatty acids (FFA) to acyl-CoA. The endogenous producer of PUFAs by PUFA synthase, *Schizochytrium*, possesses one or more ACoASs that are capable of converting the free fatty acid products of its PUFA synthase into acyl-CoA. Therefore, *Schizochytrium*, as well as other organisms that endogenously contain a PUFA synthase (e.g., other *Thraustochytrids*) or other organisms that can convert PUFA FFAs into acyl-CoAs (such as *Thalassiosira pseudo-* nana or *Crypthecodinium cohnii*), could represent sources for genes encoding enzymes that are useful in permitting or increasing the accumulation of the products of a PUFA synthase expressed in a heterologous host. Other ACoAS sequences have been described in U.S. Appl. Pub. No. 2007/0245431.

Numerous examples of genes and polypeptides having ACoAS activity are known in the art and can be used in a genetically modified organism of the invention. Examples of genes and polypeptides that can be used in a genetically modified organism of the invention can include, but are not limited to, the following codon-optimized sequences described further herein: SEQ ID NO:4 (SzACS-2 v3 protein) and SEQ ID NO:9 (hSzThACS-2 v3 gene).

Other examples of ACoAS genes and polypeptides that can be used in a genetically modified organism of the invention include, but are not limited to, ACoAS genes or polypeptides having at least 80%, at least 85%, at least 90%, at least 95%, at least 96%, at least 97%, at least 98%, at least 99% or 100% sequence identity to any one of the ACoAS or sequences described herein. Useful ranges can be selected between any of these values (for example, 80% to 100% identical, 85% to 100% identical, 90% to 100% identical, 95% to 100% identical, 80% to 99% identical, 85% to 99% identical, 90% to 99% identical, or 95% to 99% identical). Still other examples of ACoAS genes and polypeptides that can used in a genetically modified organism of the invention include, but are not limited to an active variant, fragment, portion, or derivative of any one of the ACoAS sequences described herein, wherein such a gene encodes, or such a polypeptide has, ACoAS activity.

In some embodiments, the ACoAS can be an algal ACoAS. In some embodiments, the ACoAS can comprise an amino acid sequence that is 80% to 100% identical, 85% to 100% identical, 90% to 100% identical, 95% to 100% identical, 80% to 99% identical, 85% to 99% identical, 90% to 99% identical, or 95% to 99% identical to the amino acid sequence of SEQ ID NO:4. In some embodiments, the ACoAS can comprise the amino acid sequence of SEQ ID NO:4. In some embodiments, the nucleic acid sequence encoding the ACoAS can comprise a nucleic acid sequence 80% to 99% identical, 85% to 99% identical, 90% to 99% identical, 80% to 95% identical, or 85% to 95% identical to the nucleic acid sequence of SEQ ID NO:9. In some embodiments, the nucleic acid sequence encoding the ACoAS can comprise the nucleic acid sequence of SEQ ID NO:9. In some embodiments, the nucleic acid sequence encoding the ACoAS comprises the nucleic acid sequence of SEQ ID NO:34. In some embodiments, the nucleic acid sequence encodes an amino acid sequence of SEQ ID NO:4 or any percent identity thereof described herein.

In some embodiments of the present invention, ACoAS can be provided for production and/or accumulation of ACoAS in a heterologous host as well as for improved production and/or accumulation of ACoAS in an endogenous host.

In some embodiments, a gene and/or polypeptide encoding ACoAS can be used to identify another ACoAS gene and/or polypeptide sequences and/or can be used to identify an ACoAS homolog in other cells. Such ACoAS encoding sequences can be identified, for example, in the literature and/or in bioinformatics databases well known to the skilled person. For example, the identification of a ACoAS encoding sequence in another cell type using bioinformatics can be accomplished through BLAST (as disclosed above) searching of publicly available databases with a known ACoAS encoding DNA and polypeptide sequence, such as any of those provided herein. Identities are based on the Clustal W method of alignment using the default parameters of GAP PENALTY=10, GAP LENGTH PENALTY=0.1, and Gonnet 250 series of protein weight matrix.

In some embodiments, the genetically modified plant (e.g., soybean), descendant, cell, tissue, or part thereof comprises a PUFA synthase and a ACoAS, or a PUFA synthase, a PPTase and a ACoAS. In some embodiments, the genetically modified plant (e.g., soybean), descendant, cell, tissue, or part thereof comprises the nucleic acid sequences of (i), (ii) or (iii), or any combinations thereof, contained in a single recombinant expression vector. In some embodiments, the nucleic acid sequences of (i), (ii) and (iii) are contained in different recombinant expression vectors. In some embodiments, the nucleic acid sequences of (i) and (ii) are contained in a single recombinant expression vector and the nucleic acid sequence of (iii) is contained in a different recombinant expression vector. In some embodiments, the nucleic acid sequences of (i) and (iii) are contained in a single recombinant expression vector and the nucleic acid sequence of (ii) is contained in a different recombinant expression vector. In some embodiments, the nucleic acid sequences of (ii) and (iii) are contained in a single recombinant expression vector and the nucleic acid sequence of (i) is contained in a different recombinant expression vector. In some embodiments, the nucleic acid sequences of (i), (ii) or (iii), or any combinations thereof, are under the control of one or more seed-specific promoters.

Methods of Making Genetically Modified Organisms

To produce significantly high yields of one or more desired polyunsaturated fatty acids, a plant can be genetically modified to introduce a PUFA synthase into the plant. The present invention also relates to methods to improve or enhance the effectiveness of such genetic modification and particularly, to improve or enhance the production and/or accumulation of the endproduct of a PUFA synthase, e.g., PUFAs.

Methods for gene expression in a genetically modified organism, including, but not limited to plants, are known in the art. In some embodiments, the coding region for the PUFA synthase genes to be expressed can be codon optimized for the target host cell as described below. Expression of genes in recombinant host cells including, but not limited to, plant cells, can require a promoter operably linked to a coding region of interest, and/or a transcriptional terminator. A number of promoters can be used in constructing vectors for genes, including but not limited to a seed-specific promoter (e.g., PvDlec2, LfKCS3, FAE 1, BoACP, or BnaNapinC) or a leaf-specific promoter (e.g., ubiquitin or CsVMV). Other non-limiting examples of promoters that can be used in the present invention include the acyl carrier protein promoter disclosed in WO 1992/18634; the *Phaseolus vulgaris* beta-phaseolin promoter and truncated versions disclosed in Slightom et al. (Proc. Natl. Acad. Sci. U.S.A. 80: 1897-1901; 1983); Sengupta-Gopalan et al. (Proc. Nat. Acad. Sci. 82: 3320-3324; 1985); van der Geest et al. (Plant Mol. Biol. 33: 553-557; 1997), and Bustos et al. (EMBO J. 10: 1469-1479; 1991).

In some embodiments of the present invention, a recombinant vector is an engineered (e.g., artificially produced) nucleic acid molecule that is used as a tool for manipulating a nucleic acid sequence of choice and for introducing such a nucleic acid sequence into a host cell. The recombinant vector is therefore suitable for use in cloning, sequencing, and/or otherwise manipulating the nucleic acid sequence of choice, such as by expressing and/or delivering the nucleic acid sequence of choice into a host cell to form a recombinant cell. Such a vector typically contains heterologous nucleic acid sequences, that is nucleic acid sequences that are not naturally found adjacent to nucleic acid sequence to be cloned or delivered, although the vector can also contain regulatory nucleic acid sequences (e.g., promoters, untranslated regions) that are naturally found adjacent to nucleic acid molecules of the present invention or that are useful for expression of the nucleic acid molecules of the present invention. The vector can be either RNA or DNA, either prokaryotic or eukaryotic, and typically is a plasmid. The vector can be maintained as an extrachromosomal element (e.g., a plasmid) or it can be integrated into the chromosome of a recombinant organism (e.g., a microbe or a plant). The entire vector can remain in place within a host cell, or under certain conditions, the plasmid DNA can be deleted, leaving behind the nucleic acid molecule of the present invention. The integrated nucleic acid molecule can be under chromosomal promoter control, under native or plasmid promoter control, or under a combination of several promoter controls. Single or multiple copies of the nucleic acid molecule can be integrated into the chromosome. A recombinant vector of the present invention can contain at least one selectable marker.

In some embodiments, a recombinant vector used in a recombinant nucleic acid molecule of the present invention is an expression vector. In such embodiments, a nucleic acid sequence encoding the product to be produced (e.g., a PUFA synthase) is inserted into the recombinant vector to produce a recombinant nucleic acid molecule. The nucleic acid sequence encoding the protein to be produced is inserted into the vector in a manner that operatively links the nucleic acid sequence to regulatory sequences in the vector that enable the transcription and translation of the nucleic acid sequence within the recombinant host cell.

Vectors useful for the transformation of a variety of host organisms and cells are common and disclosed in the literature. Typically the vector contains a selectable marker and sequences allowing autonomous replication or chromosomal integration in the desired host. In addition, suitable vectors can comprise a promoter region that harbors transcriptional initiation controls and a transcriptional termination control region, between which a coding region DNA fragment can be inserted, to provide expression of the inserted coding region. Both control regions can be derived from genes homologous to the transformed host cell, although it is to be understood that such control regions can also be derived from genes that are not native to the specific species chosen as a production host.

The present invention includes the expression of one or more acyl-CoA synthetases as described and exemplified herein with a PUFA synthase as described herein and with an exogenous PPTase that are utilized alone or in combination with any one or more strategies described herein (e.g., any one, two, three, or four of: codon optimization, organelle-targeting, enhancement of PUFA synthase competition for malonyl CoA (e.g., by inhibition of FAS), and/or expression of one or more acyltransferases or related enzymes), to increase PUFA production and/or accumulation in a heterologous host.

Some embodiments of the invention relate to the targeting of expression of the PUFA synthase enzymes, the PPTase, and/or any one or more of the accessory proteins and/or targeted genetic modifications to one or more organelles of the host. For example, in some embodiments, expression of the PUFA synthase system and the PPTase can be targeted to the plastid of a plant. In some embodiments, expression of the PUFA synthase and the PPTase is targeted to the cytosol.

In some embodiments, expression of the PUFA synthase and the PPTase is targeted to both the plastid and the cytosol of a plant. In any of these embodiments, other targets can be directed to the plastid or the cytosol.

In some embodiments, acyl-CoA synthetases are expressed in the cytosol to convert the DHA and/or other LC-PUFA free fatty acids to acyl-CoAs, which in turn can be utilized by the acyltransferases.

A variety of plastid targeting sequences are known in the art and can be used in embodiments where the heterologous host is a plant or plant cell, and wherein targeting to the plastid is desired.

The present invention includes the use of organelle targeting (e.g., to the plastid or chloroplast in plants) with expression of a PUFA synthase as described herein and with an exogenous PPTase, which are utilized alone or in combination with any one or more strategies described herein (e.g., any one, two, three, or four of: codon optimization, enhancement of PUFA synthase competition for malonyl CoA (e.g., by inhibition of FAS), expression of one or more acyl-CoA synthetases, and/or expression of one or more acyltransferases or related enzymes), to increase PUFA production and/or accumulation in a heterologous host.

The targeting of gene products to the plastid or chloroplast is controlled by a signal sequence found at the amino terminal end of various proteins, which is cleaved during import yielding the mature protein (e.g., with regard to chloroplast targeting, see, e.g., Comai et al., J. Biol. Chem. 263:15104-15109 (1988)). These signal sequences can be fused to heterologous gene products to effect the import of heterologous products into the chloroplast (van den Broeck et al. Nature 313:358-363 (1985)). DNA encoding for appropriate signal sequences can be isolated from the cDNAs encoding the RUBISCO protein, the CAB protein, the EPSP synthase enzyme, the GS2 protein and many other proteins that are known to be chloroplast localized.

In some embodiments of the invention, the localization of proteins employed in the invention is directed to a subcellular compartment, for example, to the plastid or chloroplast. Proteins can be directed to the chloroplast by including at their amino-terminus a chloroplast transit peptide (CTP). Similarly, proteins can be directed to the plastid by including at their N-terminus a plastid transit or signaling peptide.

Naturally occurring chloroplast targeted proteins, synthesized as larger precursor proteins containing an amino-terminal chloroplast targeting peptide directing the precursor to the chloroplast import machinery, are well known in the art. Chloroplast targeting peptides are generally cleaved by specific endoproteases located within the chloroplast organelle, thus releasing the targeted mature and can active enzyme from the precursor into the chloroplast milieu. Examples of sequences encoding peptides that are suitable for directing the targeting of the gene or gene product to the chloroplast or plastid of the plant cell include the petunia EPSPS CTP, the *Arabidopsis* EPSPS CTP2 and intron, and others known to those skilled in the art. Such targeting sequences provide for the desired expressed protein to be transferred to the cell structure in which it most effectively functions, or by transferring the desired expressed protein to areas of the cell in which cellular processes necessary for desired phenotypic function are concentrated. Specific examples of chloroplast targeting peptides are well known in the art and include the *Arabidopsis thaliana* ribulose bisphosphate carboxylase small subunit ats1A transit peptide, an *Arabidopsis thaliana* EPSPS transit peptide, and a *Zea maize* ribulose bisphosphate carboxylase small subunit transit peptide.

An optimized transit peptide is described, for example, by van den Broeck et al., Nature, 313:358-363 (1985). Prokaryotic and eukaryotic signal sequences are disclosed, for example, by Michaelis et al., Ann. Rev. Microbiol. 36:425 (1982). Additional examples of transit peptides that can be used in the invention include the chloroplast transit peptides such as those described in Von Heijne et al., Plant Mol. Biol. Rep. 9:104-126 (1991); Mazur et al., Plant Physiol. 85:1110 (1987); and Vorst et al., Gene 65:59 (1988). Chen & Jagendorf (J. Biol. Chem. 268:2363-2367 (1993)) have described use of a chloroplast transit peptide for import of a heterologous transgene. This peptide used is the transit peptide from the rbcS gene from *Nicotiana plumbaginifolia* (Poulsen et al., Mol. Gen. Genet. 205: 193-200 (1986)). One CTP that has functioned herein to localize heterologous proteins to the chloroplast was derived from *Brassica napus* acyl-ACP thioesterase.

An alternative means for localizing genes to chloroplast or plastid includes chloroplast or plastid transformation. Recombinant plants can be produced in which only the chloroplast DNA has been altered to incorporate the molecules envisioned in this application. Promoters that function in chloroplasts are known in the art (Hanley-Bowden et al., Trends in Biochemical Sciences 12:67-70 (1987)). Methods and compositions for obtaining cells containing chloroplasts into which heterologous DNA has been inserted have been described, for example, by Daniell et al. (U.S. Pat. No. 5,693,507) and Maliga et al. (U.S. Pat. No. 5,451,513).

Combinations of Strategies

According to the present invention, in the production of a heterologous host for the production and accumulation of one or more target PUFAs, any one or more (any combination) of the strategies described herein for improving the production and/or accumulation of PUFAs in the host can be used. Indeed, it is anticipated that various combinations of strategies will be additive or synergistic and provide improved production and/or accumulation of PUFAs as compared to in the absence of one or more such strategies. Indeed, the Examples provide exemplary strategies for the production of PUFAs in a host organism.

Any plant or plant cell using these combinations of modifications, or any other modification or combination of modifications described herein, is encompassed by the invention. In some embodiments, such a plant has been further genetically modified to express an accessory protein as described herein for the improvement of the production and/or accumulation of PUFAs (or other bioactive products of the PUFA synthase) by the host (e.g., ACoAS, GPAT, LPAAT, DAGAT or acetyl CoA carboxylase (ACCase)). Furthermore, any host cell or organism using any modifications or combination of modifications described herein is encompassed by the invention, as are any products derived from such cell or organisms, including seed or oil comprising the target PUFAs.

In some embodiments, plants to genetically modify according to the present invention (e.g., plant host cells) includes, but is not limited to, any higher plants, including both dicotyledonous and monocotyledonous plants, and particularly consumable plants, including crop plants and especially plants used for their oils. Such plants can include, but are not limited to, for example: soybean, rapeseed, linseed, corn, safflowers, sunflowers and tobacco. Thus, any plant species or plant cell can be selected. In some embodiments, the plant is of the family Fabaceae (Leguminosae, legume family, pea family, bean family or pulse family). In some embodiments, the plant is of the genus *Glycine*. In some embodiments, the plant is *Glycine albicans, Glycine aphyonota, Glycine arenari, Glycine argyrea, Glycine canescens, Glycine clandestine, Glycine curvata, Glycine cyrtoloba, Glycine falcate, Glycine gracei, Glycine hirticaulis, Glycine hirticaulis* subsp. *leptosa, Glycine lactovirens, Glycine latifolia, Glycine latrobeana, Glycine microphylla, Glycine montis-douglas, Glycine peratosa, Glycine pescadrensis, Glycine pindanica, Glycine pullenii, Glycine rubiginosa, Glycine stenophita, Glycine syndetika, Glycine tabacina, Glycine tomentella, Glycine soja*, or *Glycine max* (soybean). In some embodiments, the plant is peanut, beans (*Phaseolus vulgaris*), broad beans (*Vicia faba*) or peas (*Pisum sativum*).

"Plant parts," as used herein, include any parts of a plant, including, but not limited to, seeds (including mature seeds and immature seeds), pollen, embryos, flowers, fruits, shoots, leaves, roots, stems, explants, etc. In some embodiments, a genetically modified plant has a genome that is modified (e.g., mutated or changed) from its normal (e.g., wild-type or naturally occurring) form such that the desired result is achieved (e.g., increased or modified PUFA synthase and/or production and/or accumulation of a desired product using the PUFA synthase). In some embodiments, genetic modification of a plant can be accomplished using classical strain development and/or molecular genetic techniques. Methods for producing a transgenic plant, wherein a recombinant nucleic acid molecule encoding a desired amino acid sequence is incorporated into the genome of the plant, are known in the art. In some embodiments, a plant to genetically modify according to the present invention is a plant suitable for consumption by animals, including humans.

Plant lines from these plants, optimized for a particularly desirable trait, e.g., disease resistance, ease of plant transformation, oil content or profile, etc., can be produced, selected or identified. In some embodiments, plant lines can be selected through plant breeding, or through methods such as marker assisted breeding and tilling. In some embodiments, plant cell cultures can be used and, for example, are not grown into differentiated plants and cultivated using ordinary agricultural practices, but instead grown and maintained in a liquid medium.

In some embodiments, the plant can be an oil seed plant, wherein the oil seeds, and/or the oil in the oil seeds contain PUFAs produced by the PUFA synthase. In some embodiments, such oils can contain a detectable amount of at least one target or primary PUFA that is the product of the PUFA synthase. In some embodiments, such oils can be substantially free of intermediate or side products that are not the target or primary PUFA products and that are not naturally produced by the endogenous FAS system in the wild-type plants (e.g., wild-type plants produce some shorter or medium chain PUFAs, such as 18 carbon PUFAs, via the FAS system, but there will be new, or additional, fatty acids produced in the plant as a result of genetic modification with a PUFA synthase).

With regard to the production of genetically modified plants, methods for the genetic engineering of plants are well known in the art. For instance, numerous methods for plant transformation have been developed, including biological and physical transformation protocols for dicotyledonous plants as well as monocotyledonous plants (e.g., Goto-Fumiyuki et al., Nature Biotech 17:282-286 (1999); and Miki et al., Methods in Plant Molecular Biology and Biotechnology, B. R. Glick and J. E. Thompson, Eds., CRC Press, Inc., Boca Raton, pp. 67-88 (1993)). In addition, vectors and in vitro culture methods for plant cell or tissue transformation and regeneration of plants are available, for example, in Gruber et al., Methods in Plant Molecular Biology and Biotechnology, B. R. Glick and J. E. Thompson, Eds., CRC Press, Inc., Boca Raton, pp. 89-1 19 (1993).

The present invention is drawn to an isolated nucleic acid molecule comprising a nucleic acid sequence selected from SEQ ID NOs: 6-10 as well as an isolated nucleic acid molecule comprising a modification or mutation of such a sequence as described herein. The present invention is draw to isolated polypeptides comprising an amino acid sequence selected from SEQ ID NOs: 1-5 as well as an isolated polypeptide comprising a modification or mutation or such a sequence as described herein.

The present invention includes a recombinant expression vector pDAB7361. The present invention includes a recombinant expression vector pDAB7362. The present invention includes a recombinant expression vector pDAB7363. The present invention includes a recombinant expression vector pDAB7365. The present invention includes a recombinant expression vector pDAB7368. The present invention includes a recombinant expression vector pDAB7369. The present invention includes a recombinant expression vector pDAB7370. The present invention includes a recombinant expression vector pDAB100518. The present invention includes a recombinant expression vector pDAB101476. The present invention includes a recombinant expression vector pDAB9166. The present invention includes a recombinant expression vector pDAB9167. The present invention includes a recombinant expression vector pDAB7379. The present invention includes a recombinant expression vector pDAB7380. The present invention includes a recombinant expression vector pDAB9323. The present invention includes a recombinant expression vector pDAB9330. The present invention includes a recombinant expression vector pDAB9337. The present invention includes a recombinant expression vector pDAB9338. The present invention includes a recombinant expression vector pDAB9344. The present invention includes a recombinant expression vector pDAB9396. The present invention includes a recombinant expression vector pDAB101412. The present invention includes a recombinant expression vector pDAB7733. The present invention includes a recombinant expression vector pDAB7734. The present invention includes a recombinant expression vector pDAB101493. The present invention includes a recombinant expression vector pDAB109507. The present invention includes a recombinant expression vector pDAB109508. The present invention includes a recombinant expression vector pDAB109509. The present invention includes a recombinant expression vector pDAB9151. The present invention includes a recombinant expression vector pDAB108207. The present invention includes a recombinant expression vector pDAB108208. The present invention includes a recombinant expression vector pDAB108209. The present invention includes a recombinant expression vector pDAB9159. The present invention includes a recombinant expression vector pDAB9147. The present invention includes a recombinant expression vector pDAB108224. The present invention includes a recombinant expression vector pDAB108225.

The present invention includes a soybean plant, descendant, cell, tissue, seed, or part thereof comprising a recombinant expression vector pDAB7361. The present invention includes a soybean plant, descendant, cell, tissue, seed, or part thereof comprising a recombinant expression vector pDAB7362. The present invention includes a soybean plant, descendant, cell, tissue, seed, or part thereof comprising a recombinant expression vector pDAB7363. The present invention includes a soybean plant, descendant, cell, tissue, seed, or part thereof comprising a recombinant expression vector pDAB7365. The present invention includes a soybean plant, descendant, cell, tissue, seed, or part thereof comprising a recombinant expression vector pDAB7368. The present invention includes a soybean plant, descendant, cell, tissue, seed, or part thereof comprising a recombinant expression vector pDAB7369. The present invention includes a soybean plant, descendant, cell, tissue, seed, or part thereof comprising a recombinant expression vector pDAB7370. The present invention includes a soybean plant, descendant, cell, tissue, seed, or part thereof comprising a recombinant expression vector pDAB100518. The present invention includes a soybean plant, descendant, cell, tissue, seed, or part thereof comprising a recombinant expression vector pDAB101476. The present invention includes a soybean plant, descendant, cell, tissue, seed, or part thereof comprising a recombinant expression vector pDAB9166. The present invention includes a soybean plant, descendant, cell, tissue, seed, or part thereof comprising a recombinant expression vector pDAB9167.

The present invention includes a soybean plant, descendant, cell, tissue, seed, or part thereof comprising a recombinant expression vector pDAB7379. The present invention includes a soybean plant, descendant, cell, tissue, seed, or part thereof comprising a recombinant expression vector pDAB7380. The present invention includes a soybean plant, descendant, cell, tissue, seed, or part thereof comprising a recombinant expression vector pDAB9323. The present invention includes a soybean plant, descendant, cell, tissue, seed, or part thereof comprising a recombinant expression vector pDAB9330. The present invention includes a soybean plant, descendant, cell, tissue, seed, or part thereof comprising a recombinant expression vector pDAB9337. The present invention includes a soybean plant, descendant, cell, tissue, seed, or part thereof comprising a recombinant expression vector pDAB9338. The present invention includes a soybean plant, descendant, cell, tissue, seed, or part thereof comprising a recombinant expression vector pDAB9344. The present invention includes a soybean plant, descendant, cell, tissue, seed, or part thereof comprising a recombinant expression vector pDAB9396. The present invention includes a soybean plant, descendant, cell, tissue, seed, or part thereof comprising a recombinant expression vector pDAB101412. The present invention includes a soybean plant, descendant, cell, tissue, seed, or part thereof comprising a recombinant expression vector pDAB7733. The present invention includes a soybean plant, descendant, cell, tissue, seed, or part thereof comprising a recombinant expression vector pDAB7734.

The present invention includes a soybean plant, descendant, cell, tissue, seed, or part thereof comprising a recombinant expression vector pDAB101493. The present invention includes a soybean plant, descendant, cell, tissue, seed, or part thereof comprising a recombinant expression vector pDAB109507. The present invention includes a soybean plant, descendant, cell, tissue, seed, or part thereof comprising a recombinant expression vector pDAB109508. The present invention includes a soybean plant, descendant, cell, tissue, seed, or part thereof comprising a recombinant expression vector pDAB109509. The present invention includes a soybean plant, descendant, cell, tissue, seed, or part thereof comprising a recombinant expression vector pDAB9151. The present invention includes a soybean plant, descendant, cell, tissue, seed, or part thereof comprising a recombinant expression vector pDAB108207. The present invention includes a soybean plant, descendant, cell, tissue, seed, or part thereof comprising a recombinant expression vector pDAB108208. The present invention includes a soybean plant, descendant, cell, tissue, seed, or part thereof comprising a recombinant expression vector pDAB108209. The present invention includes a soybean plant, descendant, cell, tissue, seed, or part thereof comprising a recombinant expression vector pDAB9159. The present invention includes a soybean plant, descendant, cell, tissue, seed, or part thereof comprising a recombinant expression vector pDAB9147. The present invention includes a soybean plant, descendant, cell, tissue, seed, or part thereof comprising a recombinant expression vector pDAB108224. The present invention includes a soybean plant, descendant, cell, tissue, seed, or part thereof comprising a recombinant expression vector pDAB108225.

As used herein, the term "transfection" is used to refer to any method by which an exogenous nucleic acid molecule (e.g., a recombinant nucleic acid molecule) can be inserted into a cell. The term "transformation" can be used interchangeably with the term "transfection" when such term is used to refer to the introduction of nucleic acid molecules into microbial cells, such as algae, bacteria and yeast, or into plant cells. In microbial and plant systems, the term "transformation" is used to describe an inherited change due to the acquisition of exogenous nucleic acids by the microorganism or plant and is essentially synonymous with the term "transfection." In some embodiments, transfection techniques include, but are not limited to, transformation, particle bombardment, diffusion, active transport, bath sonication, electroporation, microinjection, lipofection, adsorption, infection and protoplast fusion.

A widely utilized method for introducing an expression vector into plants is based on the natural transformation system of *Agrobacterium*. Horsch et al., Science 227:1229 (1985). *A. tumefaciens* and *A. rhizogenes* are plant pathogenic soil bacteria known to be useful to genetically transform plant cells. The Ti and Ri plasmids of *A. tumefaciens* and *A. rhizogenes*, respectively, carry genes responsible for genetic transformation of the plant. C. I. Kado, Crit. Rev. Plant. Sci. 10:1 (1991). Descriptions of *Agrobacterium* vector systems and methods for *Agrobacterium*-mediated gene transfer are also available, e.g., Gruber et al., supra, Miki et al., supra, Moloney et al., Plant Cell Reports 8:238 (1989), and U.S. Pat. Nos. 4,940,838 and 5,464,763.

Another known method of plant transformation is microprojectile-mediated transformation wherein DNA is carried on the surface of microprojectiles. In this method, the expression vector is introduced into plant tissues with a biolistic device that accelerates the microprojectiles to speeds sufficient to penetrate plant cell walls and membranes. Sanford et al., Part. Sci. Technol. 5:27 (1987), J. C. Sanford, Trends Biotech. 6:299 (1988), J. C. Sanford, Physiol. Plant 79:206 (1990), Klein et al., Biotechnology 10:268 (1992).

Yet another method for physical delivery of DNA to plants is sonication of target cells. Zhang et al., Bio/Technology 9:996 (1991). Also, liposome or spheroplast fusion have been used to introduce expression vectors into plants. Deshayes et al., EMBO J., 4:2731 (1985), Christou et al., Proc. Natl. Acad. Sci. USA 84:3962 (1987). Direct uptake of DNA into protoplasts using $CaCl_2$ precipitation, polyvinyl alcohol or poly-L-ornithine have also been reported. Hain et al., Mol. Gen. Genet. 199:161 (1985) and Draper et al., Plant Cell Physiol. 23:451 (1982). Electroporation of protoplasts and whole cells and tissues has also been described. Donn et al., Abstracts of VIIth International Congress on Plant Cell and Tissue Culture IAPTC, A2-38, p. 53 (1990); D'Halluin et al., Plant Cell 4:1495-1505 (1992) and Spencer et al., Plant Mol. Biol. 24:51-61 (1994). Additionally, silicone carbide whiskers (Kaepler et al., 1990, Plant Cell Reports) and in plant transformation using, for example, a flower dipping methodology (Clough and Bent, Plant J. 16:735-743 (1998)) can also be used. The exact plant transformation methodology can vary somewhat depending on the plant species selected and the plant cell type selected for transformation (e.g., seedling derived cell types such as hypocotyls and cotyledons or embryonic tissue).

Following the introduction of the genetic construct into plant cells, plant cells can be grown and upon emergence of differentiating tissue such as shoots and roots, mature plants can be generated. In some embodiments, a plurality of plants can be generated. Methodologies for regenerating plants are known to those of ordinary skill in the art and can be found, for example, in: Plant Cell and Tissue Culture, 1994, Vasil and Thorpe Eds. Kluwer Academic Publishers and in: Plant Cell Culture Protocols (Methods in Molecular Biology 1 11, 1999 Hall Eds Humana Press).

In some embodiments, a genetically modified plant described herein can be cultured in a fermentation medium or grown in a suitable medium such as soil. In some embodiments, a suitable growth medium for higher plants can include any growth medium for plants, including, but not limited to, soil, sand, any other particulate media that support root growth (e.g., vermiculite, perlite, etc.) or hydroponic culture, as well as suitable light, water and nutritional supplements that optimize the growth of the higher plant.

It will be appreciated by one skilled in the art that use of recombinant DNA technologies can improve control of expression of transfected nucleic acid molecules by manipulating, for example, the number of copies of the nucleic acid molecules within the host cell, the efficiency with which those nucleic acid molecules are transcribed, the efficiency with which the resultant transcripts are translated, and the efficiency of post-translational modifications. Additionally, the promoter sequence might be genetically engineered to improve the level of expression as compared to the native promoter. Recombinant techniques useful for controlling the expression of nucleic acid molecules include, but are not limited to, integration of the nucleic acid molecules into one or more host cell chromosomes, addition of vector stability sequences to plasmids, substitutions or modifications of transcription control signals (e.g., promoters, operators, enhancers), substitutions or modifications of translational control signals (e.g., ribosome binding sites, Shine-Dalgarno sequences), modification of nucleic acid molecules to correspond to the codon usage of the host cell, and deletion of sequences that destabilize transcripts.

In some embodiments, a plant can include those plants that are known to produce compounds used as pharmaceutical agents, flavoring agents, nutraceutical agents, functional food ingredients or cosmetically active agents or plants that are genetically engineered to produce these compounds/agents.

All of these embodiments of the invention apply to the discussion of any of the genetically modified organisms and methods of producing and using such organisms as described herein.

Products from Genetically Modified Organisms

In some embodiments, a genetically modified organism of the invention produces one or more polyunsaturated fatty acids including, but not limited to, EPA (C20:5, n-3), DHA (C22:6, n-3), DP A (C22:5, n-6 or n-3), ARA (C20:4, n-6), GLA (CI 8:3, n-6), ALA (C18:3, n-3), and/or SDA (C18:4, n-3)), and in some embodiments, one or more longer-chain PUFAs, including, but not limited to, EPA (C20:5, n-3), DHA (C22:6, n-3), DPA (C22:5, n-6 or n-3), or DTA (C22:4, n-6), or any combination thereof. In some embodiments, a genetically modified plant of the invention produces one or more polyunsaturated fatty acids including, but not limited to, EPA (C20:5, n-3), DHA (C22:6, n-3), and/or DPA (C22:5, n-6 or n-3), or any combination thereof. In some embodiments, a genetically modified plant of the invention does not have a high oleic background.

In some embodiments, a genetically modified organism is a plant that has been genetically modified to recombinantly express a PUFA synthase and a PPTase, as described herein. In some embodiments, such a plant has been genetically modified further to express an accessory protein as described herein for the improvement of the production and/or accumulation of PUFAs (or other bioactive products of the PUFA synthase) by the host (e.g., ACoAS, GPAT, LPAAT, DAGAT or ACCase).

Some embodiments of the present invention include the production of polyunsaturated fatty acids of desired chain length and with desired numbers of double bonds and, by extension, oil seed and oils obtained from the genetically modified plants described herein (e.g., obtained from the oil or seeds of such plants) comprising these PUFAs. Examples of PUFAs that can be produced by the present invention include, but are not limited to, DHA (docosahexaenoic acid (C22:6, n-3)), ARA (eicosatetraenoic acid or arachidonic acid (C20:4, n-6)), DPA (docosapentaenoic acid (C22:5, n-6 or n-3)), and EPA (eicosapentaenoic acid (C20:5, n-3)), and any combinations thereof. The present invention allows for the production of commercially valuable lipids enriched in one or more desired (target or primary) PUFAs by the development of genetically modified plants through the use of a PUFA synthase that produces PUFAs.

In some embodiments, a given PUFA synthase derived from a particular organism will produce particular PUFA(s), such that selection of a PUFA synthase from a particular organism will result in the production of specified target or primary PUFAs. In some embodiments, the ratio of the PUFAs can differ depending on the selection of the particular PUFA synthase and on how that system responds to the specific conditions in which it is expressed. For example, use of a PUFA synthase from *Thraustochytrium* 23 B (ATCC No. 20892) can also result in the production of DHA and DPA(n-6) as the target or primary PUFAs; however, in the case of *Thraustochytrium* 23B, the ratio of DHA to DPA(n-6) is 10:1 (and can range from 8:1 to 40:1), whereas in *Schizochytrium*, the ratio is typically 2.5:1. In some embodiments, a given PUFA synthase can be modified by intermixing proteins and domains from different PUFA synthases, or one can modify a domain or protein of a given PUFA synthase to change the target PUFA product and/or ratios.

In some embodiments, reference to "intermediate products" or "side products" of an enzyme system that produces PUFAs refers to any products, and particularly, fatty acid products, that are produced by the enzyme system as a result of the production of the target or primary PUFA(s) of the system, but that are not the primary or target PUFA(s). In some embodiments, intermediate and side products can include non-target fatty acids that are naturally produced by the wild-type plant, or by the parent plant used as a recipient for the indicated genetic modification, but are now classified as intermediate or side products because they are produced in greater levels as a result of the genetic modification, as compared to the levels produced by the wild-type plant, or by the parent plant used as a recipient for the indicated genetic modification. In some embodiments, a primary or target PUFA of one enzyme system can be an intermediate of a different enzyme system where the primary or target product is a different PUFA. For example, when using the standard pathway to produce EPA, fatty acids such as GLA, DGLA and SDA are produced as intermediate products in significant quantities (e.g., U.S. Appl. Pub. No. 2004/0172682). Similarly, and also illustrated by U.S. Appl. Pub. No. 2004/0172682, when using the standard pathway to produce DHA, in addition to the fatty acids mentioned above, ETA and EPA (notably the target PUFA in the first example above) can be produced in significant quantities and can be present in significantly greater quantities relative to the total fatty acid product than the target PUFA itself.

In some embodiments, to produce significantly high yields of one or more desired polyunsaturated fatty acids, a plant can be genetically modified to introduce a PUFA synthase system into the plant. Plants are not known to endogenously contain a PUFA synthase, and therefore, the present invention represents an opportunity to produce plants with unique fatty acid production capabilities. The present invention provides genetically engineered plants to produce one or more PUFAs in the same plant, including, but not limited to, EPA, DHA, DPA (n3 or n6), ARA, GLA, SDA and others, including any combination thereof. The present invention offers the ability to create any one of a number of "designer oils" in various ratios and forms. In some embodiments, the use of a PUFA synthase from the particular marine organisms described herein can extend the range of PUFA production and successfully produce such PUFAs within temperature ranges used to grow most crop plants.

In some embodiments, to be "substantially free" of intermediate or side products of the system for synthesizing PUFAs, or to not have intermediate or side products present in substantial amounts, means that any intermediate or side product fatty acids (non-target PUFAs) that are produced in the genetically modified plant (and/or parts of plants and/or seed oil fraction) as a result of the introduction or presence of the enzyme system for producing PUFAs (e.g., that are not produced by the wild-type plant or the parent plant used as a recipient for the indicated genetic modification), can be present in a quantity that is less than 10% by weight of total fatty acids, less than 9% by weight of total fatty acids, less than 8% by weight of total fatty acids, less than 7% by weight of total fatty acids, less than 6% by weight of total fatty acids, less than 5% by weight of total fatty acids, less than 4% by weight of total fatty acids, less than 3% by weight of total fatty acids, less than 2% by weight of total fatty acids, less than 1% by weight of total fatty acids, or less than 0.5% by weight of total fatty acids.

In some embodiments, a genetically modified plant, descendant, cell, tissue, or part thereof of the invention or an oil or seed obtained from a genetically modified plant, descendant, cell, tissue, or part thereof of the invention comprises detectable amounts of DHA (docosahexaenoic acid (C22:6, n-3)), DPA(n-6) (docosapentaenoic acid (C22:5 n-6)) or EPA (eicosapentaenoic acid (C20:5, n-3)). In some embodiments, a genetically modified plant, descendant, cell, tissue, or part thereof of the invention or an oil or seed obtained from a genetically modified plant, descendant, cell, tissue, or part thereof of the invention comprises at least 0.01%, at least 0.02%, at least 0.03%, at least 0.04%, at least 0.05%, at least 0.06%, at least 0.07%, at least 0.08%, at least 0.09%, at least 0.1%, at least 0.2%, at least 0.3%, at least 0.4%, at least 0.5%, at least 0.6%, at least 0.7%, at least 0.8%, at least 0.9%, at least 1%, at least 1.5%, at least 2%, at least 2.5%, at least 3%, at least 3.5%), at least 4%, at least 4.5%, at least 5%, at least 5.5%, at least 6%, at least 6.5%, at least 7%, at least 7.5%, at least 8%, at least 8.5%, at least 9%, at least 9.5%, at least 10%, at least 10.5%, at least 11%, at least 11.5%, at least 12%, at least 12.5%, at least 13%, at least 13.5%, at least 14%, at least 14.5% or at least 15% DHA by weight of total fatty acids. Useful ranges can be selected between any of these values, for example, 0.01% to 15%, 0.05% to 10% and 1% to 5% DHA by weight of total fatty acids.

In some embodiments, a genetically modified plant, descendant, cell, tissue, or part thereof of the invention or an oil or seed obtained from a genetically modified plant, descendant, cell, tissue, or part thereof of the invention comprises at least 0.01%, at least 0.02%, at least 0.03%, at least 0.04%, at least 0.05%, at least 0.06%, at least 0.07%, at least 0.08%, at least 0.09%, at least 0.1%, at least 0.2%, at least 0.3%, at least 0.4%, at least 0.5%, at least 0.6%, at least 0.7%, at least 0.8%, at least 0.9%, at least 1%, at least 1.5%, at least 2%, at least 2.5%, at least 3%, at least 3.5%, at least 4%, at least 4.5%, at least 5%, at least 5.5%, at least 6%, at least 6.5%, at least 7%, at least 7.5%, at least 8%, at least 8.5%, at least 9%, at least 9.5%, or at least 10% EPA by weight of total fatty acids. Useful ranges can be selected between any of these values, for example, 0.01% to 10%, 0.05% to 5% and 0.1% to 5% EPA by weight of total fatty acids.

In some embodiments, a genetically modified plant, descendant, cell, tissue, or part thereof of the invention or an oil or seed obtained from a genetically modified plant, descendant, cell, tissue, or part thereof of the invention comprises at least 0.01%, at least 0.02%, at least 0.03%, at least 0.04%, at least 0.05%, at least 0.06%, at least 0.07%, at least 0.08%, at least 0.09%, at least 0.1%, at least 0.2%, at least 0.3%, at least 0.4%, at least 0.5%, at least 0.6%, at least 0.7%, at least 0.8%, at least 0.9%, at least 1%, at least 1.5%, at least 2%, at least 2.5%, at least 3%, at least 3.5%, at least 4%, at least 4.5%, at least 5%, at least 5.5%, at least 6%, at least 6.5%, at least 7%, at least 7.5%, at least 8%, at least 8.5%, at least 9%, at least 9.5%, or at least 10% DPA(n-6) by weight of total fatty acids. Useful ranges can be selected between any of these values, for example, 0.01% to 10%, 0.01% to 5%, 0.01% to 1%, 0.01% to 0.05%, 0.05% to 5% and 0.1% to 5% DPA(n-6) by weight of total fatty acids.

In some embodiments, a genetically modified plant, descendant, cell, tissue, or part thereof of the invention or an oil or seed obtained from a genetically modified plant, descendant, cell, tissue, or part thereof of the invention comprises a ratio of EPA:DHA of at least 1:1, at least 1:1.5, at least 1:2, at least 1:2.5, at least 1:3, at least 1:3.5, at least 1:4, at least 1:4.5, at least 1:5, at least 1:5.5, at least 1:6, at least 1:6.5, at least 1:7, at least 1:7.5, at least 1:8, at least 1:8.5, at least 1:9, at least 1:10, at least 1:11, at least 1:12, at least 1:13, at least 1:14, at least 1:15, at least 1:16, at least 1:17, at least 1:18, at least 1:19, at least 1:20, at least 1:21, at least 1:22, at least 1:23, at least 1:24, at least 1:25, at least 1:26, at least 1:27, at least 1:28, at least 1:29, or at least 1:30 by weight of total fatty acids. Useful ranges can be selected between any of these values, for example, a ratio of EPA:DHA of 1:1 to 1:30, 1:1 to 1:25, 1:1 to 1:20, 1:1 to 1:15, 1:1 to 1:10, 1:1 to 1:5, 1:1 to 1:3, and 1:1 to 1:2 by weight of total fatty acids.

In some embodiments, a genetically modified plant, descendant, cell, tissue, or part thereof of the invention or an oil or seed obtained from a genetically modified plant, descendant, cell, tissue, or part thereof of the invention comprises a ratio of DPA(n-6):DHA of at least 1:1, at least 1:1.5, at least 1:2, at least 1:2.5, at least 1:3, at least 1:3.5, at least 1:4, at least 1:4.5, at least 1:5, at least 1:5.5, at least 1:6, at least 1:6.5, at least 1:7, at least 1:7.5, at least 1:8, at least 1:8.5, at least 1:9, or at least 1:10 by weight of total fatty acids. Useful ranges can be selected between any of these values, for example, a ratio of DPA(n-6):DHA of 1:1 to 1:10, 1:1 to 1:5, 1:1 to 1:3 and 1:1 to 1:2 by weight of total fatty acids.

In some embodiments, an oil obtained from a genetically modified plant, descendant, cell, tissue, or part thereof or seed of the invention comprises at least 70%, at least 75%, at least 80%, at least 85%, at least 90%, at least 95%, or at least 99% triglycerides by weight of the oil. In some embodiments, an oil obtained from a genetically modified plant, descendant, cell, tissue, or part thereof or seed of the invention comprises from 70% to 99% triglycerides by weight of the oil, from 75% to 99% triglycerides by weight of the oil, from 80%) to 99% triglycerides by weight of the oil, from 85% to 99% triglycerides by weight of the oil, or from 90% to 99% triglycerides by weight of the oil. Methods for purification and analysis of triglyceride have been described (e.g., V. Ruiz-Gutierrez and L. J. Barron, J. Chromatogr. B. Biomed. Appl., 671:133-168, 1995).

In some embodiments, when the target product of a PUFA synthase system is a long chain PUFA, such as DHA, DP A (n-6 or n-3), or EPA, intermediate products and side products that are not present in substantial amounts in the total lipids of plants genetically modified with such a PUFA synthase system can include, but are not limited to: gamma-linolenic acid (GLA; 18:3, n-6); stearidonic acid (STA or SDA; 18:4, n-3); dihomo-gamma-linolenic acid (DGLA or HGLA; 20:3, n-6), arachidonic acid (ARA, C20:4, n-6); eicosatrienoic acid (ETA; 20:3, n-9) and various other intermediate or side products, such as 20:0; 20:1 ($\Delta 5$); 20:1 ($\Delta 11$); 20:2 ($\Delta 8,11$); 20:2 ($\Delta 11,14$); 20:3 ($\Delta 5,11,14$); 20:3 ($\Delta 11,14,17$); mead acid (20:3; $\Delta 5,8,11$); or 20:4 ($\Delta 5,1,14,17$).

The genetic modification of a plant according to the present invention can result in the production of one or more PUFAs by the plant. In some embodiments, the PUFA profile and the ratio of the PUFAs produced by the plant are not necessarily the same as the PUFA profile or ratio of PUFAs produced by the organism from which the PUFA synthase was derived.

In some embodiments, a genetically modified plant, descendant, cell, tissue, or part thereof of the present invention can be engineered to produce PUFAs through the activity of the PUFA synthase. In some embodiments, the PUFAs can be recovered through purification processes that extract the compounds from the plant, descendant, cell, tissue, or part thereof. In some embodiments, the PUFAs can be recovered by harvesting the plant, descendant, cell, tissue, or part thereof In some embodiments, the PUFAs can be recovered by harvesting the oil from the plant, descendant, cell, tissue, or part thereof (e.g., from the oil seeds) or seeds from the plant, descendant, cell, tissue, or part thereof. In some embodiments, the plant, descendant, cell, tissue, or part thereof can also be consumed in its natural state or further processed into consumable products.

In some embodiments, a genetically modified plant, descendant, cell, tissue, or part thereof of the invention can produce one or more polyunsaturated fatty acids. In some embodiments, the plant, descendant, cell, tissue, or part thereof can produce (e.g., in its mature seeds, if an oil seed plant, or in the oil of the seeds of an oil seed plant) at least one PUFA (the target PUFA), and wherein the total fatty acid profile in the plant, or the part of the plant that accumulates PUFAs (e.g., mature seeds, if the plant is an oil seed plant or the oil of the seeds of an oil seed plant), comprises a detectable amount of this PUFA or PUFAs. In some embodiments, the target PUFA is at least a 20 carbon PUFA and comprises at least 3 double bonds, at least 4 double bonds, or at least 5 double bonds. In some embodiments, the target PUFA can be a PUFA that is not naturally produced by the plant. In some embodiments, the total fatty acid profile in the plant or in the part of the plant that accumulates PUFAs (including the seed oil of the plant) comprises at least 0.1% of the target PUFA(s) by weight of total fatty acids, at least 0.2%, at least 0.3%, at least 0.4%, at least 0.5%, at least 1%, at least 1.5%, at least 2%, at least 2.5%, at least 3%, at least 3.5%, at least 4%, at least 4.5%, at least 5%, at least 5.5%, at least 10%, at least 15%, at least 20%, at least 25%, at least 30%, at least 35%, at least 40%, at least 45%, at least 50%, at least 55%, at least 60%, at least 65%, at least 70%, at least 75%, more than 75% of at least one polyunsaturated fatty acid (the target PUFA or PUFAs) by weight of total fatty acids, or any percentage from 0.1% to 75%, or greater than 75% (up to 100% or 100%), in 0.1% increments, of the target PUFA(s).

As used herein, reference to a percentage amount of PUFA is the percentage by weight of total fatty acids extracted, unless otherwise stated. In some embodiments, total fatty acids are determined by gas chromatography (GC) analysis of a fatty acid methyl ester (F AME) preparation, although determination of total fatty acids is not limited to this method.

In some embodiments, the total fatty acids in a plant of the invention (and/or descendant, cell, tissue, or part thereof or seed oil fraction) can contain less than 10% by weight of the total fatty acids produced by the plant, less than 9% by weight of the total fatty acids produced by the plant, less than 8% by weight of the total fatty acids produced by the plant, descendant, cell, tissue, or part thereof, less than 7% by weight of the total fatty acids produced by the plant, descendant, cell, tissue, or part thereof, less than 6% by weight of the total fatty acids produced by the plant, descendant, cell, tissue, or part thereof, less than 5% by weight of the total fatty acids produced by the plant, descendant, cell, tissue, or part thereof, less than 4% by weight of the total fatty acids produced by the plant, descendant, cell, tissue, or part thereof, less than 3% by weight of the total fatty acids produced by the plant, descendant, cell, tissue, or part thereof, less than 2% by weight of the total fatty acids produced by the plant, descendant, cell, tissue, or part thereof, less than 1% by weight of the total fatty acids produced by the plant, descendant, cell, tissue, or part thereof of a fatty acid selected from gamma-linolenic acid (GLA; 18:3, n-6); stearidonic acid (STA or SDA; 18:4, n-3); dihomo-gamma-linolenic acid (DGLA or HGLA; 20:3, n-6), arachidonic acid (ARA, C20:4, n-6); eicosatrienoic acid (ETA; 20:3, n-9) and various other fatty acids, such as 20:0; 20:1 ($\Delta$5); 20:1 ($\Delta$11); 20:2 ($\Delta$8,11); 20:2 ($\Delta$11,14); 20:3 ($\Delta$5,11,14); 20:3 ($\Delta$11,14, 17); mead acid (20:3; $\Delta$5,8,11); or 20:4 ($\Delta$5,1,14,17).

The present invention includes any seed produced by the plants, descendants, cells, tissues, or parts thereof described herein, as well as any oil produced by a plant, descendant, cell, tissue, or part thereof or seed of the present invention. The present invention also includes any products produced using the plants, descendants, cells, tissues, or parts thereof, seed or oils as described herein.

Uses and Products Related to the Genetically Modified Organisms of the Invention The present invention includes a method to produce PUFAs by growing or culturing a genetically modified plant, descendant, cell, tissue, or part thereof (e.g., soybean) of the present invention described in detail above. In some embodiments, such a method includes, for example, growing in a suitable environment, such as soil, a plant that has a genetic modification as described previously herein and in accordance with the present invention.

The present invention includes a method to produce an oil comprising at least one PUFA, comprising recovering oil from a genetically modified plant, descendant, cell, tissue, or part thereof of the invention or from a seed of a genetically modified plant, descendant, cell, tissue, or part thereof of the invention.

The present invention includes a method to produce an oil comprising at least one PUFA, comprising growing a genetically modified plant, descendant, cell, tissue, or part thereof of the invention. The present invention includes a method to produce at least one PUFA in a seed oil comprising recovering an oil from a seed of a genetically modified plant, descendant, cell, tissue, or part thereof of the invention. The present invention includes a method to produce at least one PUFA in a seed oil comprising growing a genetically modified plant, descendant, cell, tissue, or part thereof of the invention.

The present invention includes a method to provide a supplement or therapeutic product containing at least one PUFA to an individual in need thereof, comprising providing to the individual in need thereof a genetically modified plant, descendant, cell, tissue, or part thereof of the invention, an oil of the invention, a seed of the invention, a food product of the invention, a functional food of the invention, or a pharmaceutical product of the invention. The present invention also includes a method to produce a genetically modified plant, descendant, cell, tissue, or part thereof of the invention comprising transforming a plant or plant cell with (i) a nucleic acid sequence encoding an algal PUFA synthase system that produces at least one polyunsaturated fatty acid (PUFA); and (ii) a nucleic acid sequence encoding a phosphopantetheinyl transferase (PPTase) that transfers a phosphopantetheinyl cofactor to an algal PUFA synthase system ACP domain. In some embodiments, the method further comprises transforming the plant or plant cell with (iii) a nucleic acid sequence encoding an acyl-CoA synthetase (ACoAS) that catalyzes the conversion of long chain PUFA free fatty acids (FF A) to acyl-CoA.

In some embodiments, the PUFA of such methods of the invention is DHA, DPA(n-6) and/or EPA. In some embodiments, the oil produced by such methods of the invention is a soybean oil. In some embodiments, the oil produced by such methods of the invention comprises 0.05% to 15% DHA by weight of total fatty acids, or any amount or range thereof described further herein. In some embodiments, the oil produced by such methods of the invention further comprises 0.01% to 5% EPA by weight of total fatty acids, or any amount or range thereof described further herein. In some embodiments, the oil produced by such methods of the invention further comprises 0.01% to 5% DPA(n-6) by weight of total fatty acids, or any amount or range thereof described further herein. In some embodiments, the oil produced by such methods of the invention comprises a ratio of EPA:DHA of 1:1 to 1:30 by weight of total fatty acids, a ratio of EPA:DHA of 1:1 to 1:3 by weight of total fatty acids, or any amount or range thereof described further herein. In some embodiments, the oil produced by such methods of the invention further comprises a ratio of DPA(n-6):DHA of 1:1 or 1:10 by weight of total fatty acids, a ratio of DPA(n-6):DHA of 1:1 to 1:3 by weight of total fatty acids, or any amount or range thereof described further herein.

The present invention further includes any organisms or parts thereof described herein (e.g., plants, descendants, cells, tissues, seeds, or parts thereof (e.g., oil seeds), or preparations or fractions thereof), as well as any oils produced by the organisms described herein. The invention also includes any products produced using the organisms, parts thereof, or oils described herein.

The present invention relates to a method to modify a product containing at least one fatty acid, comprising adding to the product an organism, part thereof, or oil produced by a genetically modified organism according to the invention and as described herein (e.g., a plant, descendant, cell, seed, tissue, or part thereof that has been genetically modified as described herein). Any products produced by this method or generally containing any organisms, parts thereof, or oils from the organisms described herein are also encompassed by the invention.

In some embodiments, the product is selected from a food dietary supplement, a pharmaceutical formulation, a humanized animal milk, an infant formula, a nutraceutical and a functional food. Suitable pharmaceutical formulations include, but are not limited to, an anti-inflammatory formulation, a chemotherapeutic agent, an active excipient, an osteoporosis drug, an anti-depressant, an anti-convulsant, an anti-*Helicobacter pylori* drug, a drug for treatment of neurodegenerative disease, a drug for treatment of degenerative liver disease, an antibiotic, and a cholesterol lowering formulation. In some embodiments, the product is used to treat a condition selected from chronic inflammation, acute inflammation, gastrointestinal disorder, cancer, cachexia, cardiac restenosis, neurodegenerative disorder, degenerative disorder of the liver, blood lipid disorder, osteoporosis, osteoarthritis, autoimmune disease, preeclampsia, preterm birth, age related maculopathy, pulmonary disorder, and peroxisomal disorder.

In some embodiments, the product is a food product or functional food product. Suitable food products include, but are not limited to, fine bakery wares, bread and rolls, breakfast cereals, processed and unprocessed cheese, condiments (ketchup, mayonnaise, etc.), dairy products (milk, yogurt), puddings and gelatin desserts, carbonated drinks, teas, powdered beverage mixes, processed fish products, fruit-based drinks, chewing gum, hard confectionery, frozen dairy products, processed meat products, nut and nut-based spreads, pasta, processed poultry products, gravies and sauces, potato chips and other chips or crisps, chocolate and other confectionery, soups and soup mixes, soya based products (e.g., milks, drinks, creams, whiteners), vegetable oil-based spreads, and vegetable-based drinks.

In some embodiments of the invention, the product is a feed or meal composition, or an additive for a feed or meal composition, for an animal. The term "animal" includes humans and non-humans. Non-limiting examples of animals are non-ruminants (e.g., pigs, poultry, or fish), and ruminants (e.g., cows, sheep and horses). The term feed or feed composition means any compound, preparation, mixture, or composition suitable for, or intended for intake by an animal.

In some embodiments, the invention is directed to an oil blend comprising an oil obtained from a genetically modified plant, descendant, tissue, or part thereof described herein, and another oil. In some embodiments, the another oil is seed oil, vegetable oil, fish oil, microbial oil, or mixture thereof.

In some embodiments, an oil obtained from a genetically modified plant, descendant, tissue, or part thereof described herein can be further processed to modify the LC-PUFAs in the oil, for example, to form esters and/or to purify the LC-PUFAs for medicinal purposes.

Some embodiments of the present invention are directed to a soybean oil comprising 0.05% to 15% DHA by weight of total fatty acids, or any range thereof described further herein. In some embodiments, the soybean oil further comprises 0.05% to 5% EPA by weight of total fatty acids. In some embodiments, the soybean oil further comprises 0.01% to 5% DPA(n-6) by weight of total fatty acids. In some embodiments, the soybean oil has a fatty acid profile of greater than 3.5% alpha-linolenic acid by weight of total fatty acids or any range thereof described further herein. Some embodiments of the present invention are directed to a composition comprising a soybean oil described herein. In some embodiments, the composition comprising a soybean oil comprises one or more oils. In some embodiments, the composition does not contain a PUFA (e.g., DHA) from a source that is not soybean.

Additional objects, advantages, and novel features of this invention will become apparent to those skilled in the art upon examination of the following examples thereof, which are not intended to be limiting.

EXAMPLES

Example 1

Codon Optimization of PUFA Synthase OrfA, PUFA Synthase OrfB, PUFA Synthase OrfC, Acyl-CoA Synthetase and 4' Phosphopantetheinyl Transferase HetI Analysis of the DNA sequences encoding PUFA synthase OrfA from *Schizochytrium* sp. ATCC_20888 (GenBank ID: AF378327, GI:158518688), PUFA synthase OrfB from *Schizochytrium* sp. ATCC 20888 (GenBank ID: AF378328, GI:158518690), PUFA synthase chimeric OrfC from *Schizochytrium* sp. ATCC 20888 and *Thraustochytrium* (U.S. Appl. Pub. No. 2008/0022422, now U.S. Pat. No. 8,003,772, issued Aug. 23, 2011) (also described as "hybrid OrfC"), acyl-CoA synthetase from *Schizochytrium* sp. ATCC 20888 (U.S. Appl. Pub. No. 2007/0245431), and 4' phosphopantetheinyl transferase HetI from *Nostoc* sp. PCC 7120 (GenBank ID: P37695, GI:20141367) revealed the presence of several sequence motifs containing non-optimal codon compositions that may be detrimental to optimal plant expression. The design of the gene(s) encoding PUFA synthase OrfA, PUFA synthase OrfB, PUFA synthase chimeric OrfC, acyl-CoA synthetase and 4' phosphopantetheinyl transferase HetI proteins was optimized to generate a DNA sequence that is more "plant-like" in nature, and in which the sequence modifications do not hinder translation or create mRNA instability through non-optimal codon composition.

Due to the plasticity afforded by the redundancy/degeneracy of the genetic code (e.g., some amino acids are specified by more than one codon), evolution of the genomes in different organisms or classes of organisms has resulted in differential usage of synonymous codons. This "codon bias" is reflected in the mean base composition of protein coding regions. For example, organisms having genomes with relatively low G+C contents utilize more codons having A or T in the third position of synonymous codons, whereas those having higher G+C contents utilize more codons having G or C in the third position. Further, it is thought that the presence of "minor" codons within an mRNA may reduce the absolute translation rate of that mRNA, especially when the relative abundance of the charged tRNA corresponding to the minor codon is low. An extension of this reasoning is that the diminution of translation rate by individual minor codons would be at least additive for multiple minor codons. Therefore, mRNAs having high relative contents of minor codons would have correspondingly low translation rates. This rate would be reflected by correspondingly low levels of the encoded protein.

In engineering genes encoding a PUFA synthase OrfA, PUFA synthase OrfB, PUFA synthase chimeric OrfC, acyl-CoA synthetase and 4' phosphopantetheinyl transferase HetI protein for expression in dicotyledonous plants (such as tobacco, soybean, cotton or canola), the codon usages for canola were accessed from publicly available databases (Table 1).

DNA sequence was then designed that encoded essentially the same amino acid sequence of an PUFA synthase OrfA, PUFA synthase OrfB, PUFA synthase OrfC, acyl-CoA synthetase and 4' phosphopantetheinyl transferase HetI, but that differed from the original DNA sequence (encoding the PUFA synthase OrfA, PUFA synthase OrfB, PUFA synthase chimeric OrfC, acyl-CoA synthetase and 4' phosphopantetheinyl transferase HetI) by the substitution of plant (first preferred, second preferred, third preferred, or fourth preferred, etc.) codons to specify the amino acid at each position within the amino acid sequence.

The new sequences were then analyzed for restriction enzyme sites created by the modifications in the sequence. The identified sites were then modified by replacing the codons with first, second, third, or fourth choice preferred

TABLE 1

Synonymous codon representation in coding regions of dicotyledonous plants from *Brassica napus* (canola) genes (Columns C and G). Values for a balanced-biased codon representation set for a plant-optimized synthetic gene design are in Columns D and H.

| A<br>Amino Acid | B<br>Codon | C<br>Canola<br>% | D<br>Weighted<br>Average | E<br>Amino Acid | F<br>Codon | G<br>Canola<br>% | H<br>Weighted<br>Average |
|---|---|---|---|---|---|---|---|
| ALA (A) | GCA | 23.3 | 23.3 | LEU (L) | CTA | 10.1 | DNU |
|  | GCC | 21.2 | 21.2 |  | CTC | 22.8 | 28.5 |
|  | GCG | 14.2 | 14.2 |  | CTG | 11.6 | 14.6 |
|  | GCT | 41.3 | 41.3 |  | CTT | 25.2 | 31.6 |
| ARG (R) | AGA | 31.8 | 43.8 |  | TTA | 10.1 | DNU |
|  | AGG | 22.1 | 30.5 |  | TTG | 20.2 | 25.3 |
|  | CGA | 9.9 | DNU | LYS (K) | AAA | 44.6 | 44.6 |
|  | CGC | 8.9 | DNU |  | AAG | 55.4 | 55.4 |
|  | CGG | 8.6 | DNU | MET (M) | ATG | 100.0 | 100.0 |
|  | CGT | 18.6 | 25.7 | PHE (F) | TTC | 58.6 | 58.6 |
| ASN (N) | AAC | 62.6 | 62.6 |  | TTT | 41.4 | 41.4 |
|  | AAT | 37.4 | 37.4 | PRO (P) | CCA | 29.6 | 29.6 |
| ASP (D) | GAC | 42.5 | 42.5 |  | CCC | 14.6 | 14.6 |
|  | GAT | 57.5 | 57.5 |  | CCG | 18.4 | 18.4 |
| CYS (C) | TGC | 49.2 | 49.2 |  | CCT | 37.3 | 37.3 |
|  | TGT | 50.8 | 50.8 | SER (S) | AGC | 16.0 | 17.9 |
| END | TAA | 38.5 | DNU |  | AGT | 14.1 | 15.8 |
|  | TAG | 22.1 | DNU |  | TCA | 18.2 | 20.4 |
|  | TGA | 39.4 | 100.0 |  | TCC | 16.7 | 18.7 |
| GLN (Q) | CAA | 50.0 | 50.0 |  | TCG | 10.7 | DNU |
|  | CAG | 50.0 | 50.0 |  | TCT | 24.3 | 27.2 |
| GLU (E) | GAA | 43.6 | 43.6 | THR (T) | ACA | 26.3 | 26.3 |
|  | GAG | 56.4 | 56.4 |  | ACC | 26.9 | 26.9 |
| GLY (G) | GGA | 36.4 | 36.4 |  | ACG | 16.9 | 16.9 |
|  | GGC | 16.2 | 16.2 |  | ACT | 30.0 | 30.0 |
|  | GGG | 15.2 | 15.2 | TRP (W) | TGG | 100.0 | 100.0 |
|  | GGT | 32.1 | 32.1 | TYR (Y) | TAC | 59.4 | 59.4 |
| HIS (H) | CAC | 49.6 | 49.6 |  | TAT | 40.6 | 40.6 |
|  | CAT | 50.4 | 50.4 | VAL (V) | GTA | 10.8 | DNU |
| ILE (I) | ATA | 21.1 | 21.1 |  | GTC | 24.1 | 27.0 |
|  | ATC | 42.7 | 42.7 |  | GTG | 28.3 | 31.7 |
|  | ATT | 36.2 | 36.2 |  | GTT | 36.8 | 41.3 |

*DNU—Do Not Use

To balance the distribution of the remaining codon choices for an amino acid, a Weighted Average representation for each codon was calculated (Table 1), using the formula: Weighted Average % of C1=1/(% C1+% C2+% C3+ etc.)×% C1×100, where C1 is the codon in question and % C2, % C3, etc. represent the averages of the % values for canola of remaining synonymous codons (average % values for the relevant codons are taken from Columns C and G) of Table 1. The Weighted Average % value for each codon is given in Columns D and H of Table 1.

In designing coding regions for plant expression, the primary ("first choice") codons preferred by the plant was determined, as well as the second, third, fourth etc. choices of preferred codons when multiple choices exist. A new codons. The sequence was then further analyzed and modified to reduce the frequency of TA or GC doublets.

Analysis of these sequences revealed that the new DNA sequences encoded essentially the amino acid sequence of the PUFA synthase OrfA, PUFA synthase OrfB, PUFA synthase chimeric OrfC, acyl-CoA synthetase and 4' phosphopantetheinyl transferase HetI proteins but were respectively designed for optimal expression in dicotyledonous plants using a balanced codon distribution of frequently used codons found in canola genes. In particular, the new DNA sequences differed from the original DNA sequences encoding an PUFA synthase OrfA, PUFA synthase OrfB, PUFA synthase chimeric OrfC, acyl-CoA synthetase and 4' phosphopantetheinyl transferase HetI by the substitution of plant (first preferred, second preferred, third preferred, or fourth preferred) codons to specify the appropriate amino acid at each position within the protein amino acid sequence.

Design of the plant-optimized DNA sequences were initiated by reverse-translation of the protein sequences of PUFA synthase OrfA (SEQ ID NO:1), PUFA synthase OrfB (SEQ ID NO:2), PUFA synthase chimeric OrfC (SEQ ID NO:3), acyl-CoA synthetase (SEQ ID NO:4) and 4' phosphopantetheinyl transferase HetI (SEQ ID NO:5) using a canola codon bias table constructed from Table 1, Columns D and H. The protein sequence for acyl-CoA synthetase (SEQ ID NO:4) was altered from the original sequence; wherein the second amino acid Alanine was removed from the protein. The initial sequences were then modified by compensating codon changes (while retaining overall weighted average codon representation) to remove or add restriction enzyme recognition sites, remove highly stable intrastrand secondary structures, and remove other sequences that might be detrimental to cloning manipulations or expression of the engineered gene in plants. The DNA sequences were then re-analyzed for restriction enzyme recognition sites that might have been created by the modifications. The identified sites were further modified by replacing the relevant codons with first, second, third, or fourth choice preferred codons. Other sites in the sequences that could affect transcription or translation of the gene of interest include the exon:intron junctions (5' or 3'), poly A addition signals, or RNA polymerase termination signals. The modified sequences were further analyzed and further modified to reduce the frequency of TA or CG doublets, and to increase the frequency of TG or CT doublets. In addition to these doublets, sequence blocks that have more than about six consecutive residues of [G+C] or [A+T] can affect transcription or translation of the sequence. Therefore, these sequence blocks were also modified by replacing the codons of first or second choice, etc. with other preferred codons of choice. Rarely used codons are not included to a substantial extent in the gene design, being used only when necessary to accommodate a different design criterion than codon composition per se (e.g., addition or deletion of restriction enzyme recognition sites).

The protein encoded by PUFA synthase OrfA comprises 10 repeated "Proline-Alanine" domains ranging in size from 17 to 29 amino acids. Interspersed between the Proline-Alanine repeats were 9 longer repeated sequence domains comprising 87 amino acids. The amino acid sequences of these repeats vary at only 4 positions, and there were only two codon choices at each of the variant positions. Analyses of the amino acid sequences of the 9 repeats using the Clustal W computer program generated a homology value of 100%, and an identity value of 95.4%. At the DNA level, the sequences encoding the 9 repeats are 100%) homologous, 89.7% identical, varying at only 27 positions in the 261 bases encoding each repeat (23 of the 27 changes are "silent" differences, in which synonymous codons for the same amino acid are interchanged).

Standard gene design processes cannot easily accommodate developing new codon biased DNA sequences for multiple repeats of this size, since one must continually balance all the codon choices in an individual repeat with the codon choices made at the same position in the other 8 repeats, to avoid generating highly related DNA sequences. For each of the 87 residue repeats, there were more than $4.5 \times 10^{43}$ possible DNA sequences to encode the same amino acid sequence (calculated as the product of the number of synonymous codons for each amino acid in the sequence). Thus, there was a very large computing space available to generate identically-encoding DNA sequences. The following protocol describes a method used to generate (in silico) multiple sequence designs for each individual repeat, followed by comparison of all the sequence versions in bulk to identify a set that represents highly diverged sequences encoding the repeats:

Step 1: Extract the native DNA sequence encoding each repeated amino acid domain as a separate sequence.

Step 2: Import the individual repeated DNA sequences as separate sequences into a gene design program (e.g., OPTGENE™, Ocimum Biosolutions, Hyderabad, India). Steps 3-5 are performed on each sequence separately.

Step 3: Translate the DNA sequence using the standard genetic code.

Step 4: Reverse translate the translated protein sequence using the standard genetic code and the appropriate codon bias table. In this example, a biased codon table compiled from 530 *Brassica napus* protein coding regions was used, and each generated sequence was code-named "nap" (for "*napus*") plus the version number. Thus, the first reverse-translated, codon biased sequence for Repeat 1 was named "rpt1 nap1." In this illustration, this process was performed 10 times, to generate 10 DNA sequence versions encoding the protein sequence of Repeat 1.

Step 5: Export the 10 sequence versions into the corresponding number of text files.

Step 6: Repeat Steps 3-5 for each of the other repeated sequence domains. In this illustration, a total of 90 "nap" sequence versions were generated (10 for each repeated element).

Step 7: Import the 90 sequence files into the Clustal W program Mega 3.1 (accessed at Megasoftware) and perform a multiple sequence alignment using all 90 sequences as input. Because these sequences are segments of protein coding regions, the alignments are performed with no gaps allowed. After Clustal W Alignment, a Neighbor-Joining tree is assembled and visualized, and one of the ten codon-optimized sequences for each of the nine repeated domains in the protein is picked visually. Each selected sequence version is chosen from a section of the tree that is the most deeply branched.

Step 8: The chosen sequence for each repeated domain is incorporated into the codon-optimized DNA sequence encoding the entire protein, in the proper position for each particular repeat.

Step 9: Final analyses of the entire codon optimized sequence, including the separately designed diverged repeat elements, are performed to assure the absence of undesired motifs, restriction enzyme recognition sites, etc.

Employing this method with the codon optimization of the PUFA synthase OrfA coding sequence resulted in the selection of repeated Proline-Alanine sequences that are sufficiently diverged to avoid repeated sequence instability. These sequences were chosen from the deepest branches of the Neighbor-Joining tree (i.e., are the most distantly related to one another in this sequence set). Smith-Wasserman global alignments were done for all pair wise combinations and the range of homology was 74-81% with a probable median of 76-77% (Table 2).

TABLE 2

Smith-Wasserman homologies of selected codon-optimized sequences of repeats of PUFA OrfA.

| | rpt1 nap9 | rpt2 nap10 | rpt3 nap10 | rpt4 nap1 | rpt5 nap 10 | rpt6 nap6 | rpt7 nap9 | rpt8 nap4 | rpt9 nap10 |
|---|---|---|---|---|---|---|---|---|---|
| rpt1 nap9 | 100 | 77 | 74 | 77 | 74 | 77 | 81 | 76 | 76 |
| rpt2 nap10 | | 100 | 81 | 76 | 74 | 77 | 79 | 76 | 77 |
| rpt3 nap10 | | | 100 | 79 | 80 | 74 | 74 | 76 | 78 |
| rpt4 nap1 | | | | 100 | 80 | 77 | 75 | 76 | 76 |
| rpt5 nap10 | | | | | 100 | 78 | 77 | 77 | 77 |
| rpt6 nap6 | | | | | | 100 | 78 | 76 | 77 |
| rpt7 nap9 | | | | | | | 100 | 75 | 74 |
| rpt8 nap4 | | | | | | | | 100 | 76 |
| rpt9 nap10 | | | | | | | | | 100 |

A Clustal W alignment (Vector NTI, Invitrogen, Carlsbad, Calif.) of the chosen 9 newly designed coding regions for the 9 repeated domains is shown in FIG. 1. Overall, the sequences are 93.1% homologous, 61.7% identical as compared to the original sequences, which were 100% homologous and 89.7% identical. Greater sequence divergence could be achieved by using more than 10 sequence iterations and employing a computer program or mathematical algorithm to select from these sequences (instead of choosing sequences visually). Nevertheless, the sequences exemplified are highly divergent, and produced stable poly-nucleotide fragments.

The newly designed, canola optimized PUFA synthase OrfA, PUFA synthase OrfB, PUFA synthase chimeric OrfC, acyl-CoA synthetase and 4' phosphopantetheinyl transferase HetI DNA sequences are listed, respectively, in SEQ ID NO:6, SEQ ID NO:7, SEQ ID NO:8, SEQ ID NO:9 and SEQ ID NO:10. These codon optimized sequences are identified as version 3 (v3) throughout the specification, whereas the sequences that are non-codon optimized are referred to as version 2 (v2) throughout the specification.

The resulting DNA sequences have a higher degree of codon diversity, a desirable base composition, contain strategically placed restriction enzyme recognition sites, and lack sequences that might interfere with transcription of the gene, or translation of the product mRNA. Table 3, Table 4, Table 5, Table 6 and Table 7 present the comparisons of the codon compositions of the coding regions for the PUFA synthase OrfA, PUFA synthase OrfB, PUFA synthase chimeric OrfC, acyl-CoA synthetase and 4' phosphopantetheinyl transferase HetI proteins found in the original gene, the plant-optimized versions and the codon composition recommendations for a plant optimized sequence as calculated from Table 1, Columns D and H.

TABLE 3

PUFA OrfA codon compositions

| Amino Acid | Codon | Original Gene # | Original Gene % | Plnt Opt Gene # | Plnt Opt Gene % | Plnt Opt Recm'd | Amino Acid | Codon | Original Gene # | Original Gene % | Plnt Opt Gene # | Plnt Opt Gene % | Plnt Opt Recm'd |
|---|---|---|---|---|---|---|---|---|---|---|---|---|---|
| ALA (A) | GCA | 7 | 1.5 | 109 | 23.3 | 23.3 | LEU (L) | CTA | 0 | 0.0 | 0 | 0.0 | 0.0 |
| | GCC | 302 | 64.5 | 99 | 21.2 | 21.2 | | CTC | 173 | 77.9 | 63 | 28.4 | 28.5 |
| | GCG | 49 | 10.5 | 67 | 14.3 | 14.2 | | CTG | 15 | 6.8 | 32 | 14.4 | 14.6 |
| | GCT | 110 | 23.5 | 193 | 41.2 | 41.3 | | CTT | 33 | 14.9 | 71 | 32.0 | 31.6 |
| ARG (R) | AGA | 0 | 0.0 | 57 | 43.5 | 43.8 | | TTA | 0 | 0.0 | 0 | 0.0 | 0.0 |
| | AGG | 0 | 0.0 | 40 | 30.5 | 30.5 | | TTG | 1 | 0.5 | 56 | 25.2 | 25.3 |
| | CGA | 0 | 0.0 | 0 | 0.0 | 0.0 | LYS (K) | AAA | 2 | 1.2 | 73 | 44.5 | 44.6 |
| | CGC | 112 | 85.5 | 0 | 0.0 | 0.0 | | AAG | 162 | 98.8 | 91 | 55.5 | 55.4 |
| | CGG | 1 | 0.8 | 0 | 0.0 | 0.0 | MET (M) | ATG | 88 | 100 | 88 | 100 | 100.0 |
| | CGT | 18 | 13.7 | 34 | 26.0 | 25.7 | PHE (F) | TTC | 50 | 69.4 | 42 | 58.3 | 58.6 |
| ASN (N) | AAC | 73 | 97.3 | 47 | 62.7 | 62.6 | | TTT | 22 | 30.6 | 30 | 41.7 | 41.4 |
| | AAT | 2 | 2.7 | 28 | 37.3 | 37.4 | PRO (P) | CCA | 2 | 1.3 | 45 | 30.0 | 29.6 |
| ASP (D) | GAC | 126 | 76.8 | 70 | 42.7 | 42.5 | | CCC | 56 | 37.3 | 22 | 14.7 | 14.6 |
| | GAT | 38 | 23.2 | 94 | 57.3 | 57.5 | | CCG | 46 | 30.7 | 27 | 18.0 | 18.4 |
| CYS (C) | TGC | 34 | 94.4 | 18 | 50.0 | 49.2 | | CCT | 46 | 30.7 | 56 | 37.3 | 37.3 |
| | TGT | 2 | 5.6 | 18 | 50.0 | 50.8 | SER (S) | AGC | 40 | 21.3 | 34 | 18.1 | 17.9 |
| END | TAA | 1 | 100.0 | 0 | 0.0 | 0.0 | | AGT | 1 | 0.5 | 30 | 16.0 | 15.8 |
| | TAG | 0 | 0.0 | 0 | 0.0 | 0.0 | | TCA | 0 | 0.0 | 38 | 20.2 | 20.4 |
| | TGA | 0 | 0.0 | 1 | 100.0 | 100.0 | | TCC | 70 | 37.2 | 35 | 18.6 | 18.7 |
| GLN (Q) | CAA | 4 | 4.4 | 46 | 50.5 | 50.0 | | TCG | 59 | 31.4 | 0 | 0.0 | 0.0 |
| | CAG | 87 | 95.6 | 45 | 49.5 | 50.0 | | TCT | 18 | 9.6 | 51 | 27.1 | 27.2 |
| GLU (E) 16 | GAA | 9 | 3.8 | 103 | 43.6 | 43.6 | THR (T) | ACA | 2 | 1.3 | 41 | 26.3 | 26.3 |
| | GAG | 227 | 96.2 | 133 | 56.4 | 56.4 | | ACC | 81 | 51.9 | 42 | 26.9 | 26.9 |
| GLY (G) | GGA | 6 | 3.1 | 71 | 36.2 | 36.4 | | ACG | 26 | 16.7 | 26 | 16.7 | 16.9 |
| | GGC | 156 | 79.6 | 32 | 16.3 | 16.2 | | ACT | 47 | 30.1 | 47 | 30.1 | 30.0 |
| | GGG | 0 | 0.0 | 30 | 15.3 | 15.2 | TRP (W) | TGG | 13 | 100 | 13 | 100 | 100.0 |
| | GGT | 34 | 17.3 | 63 | 32.1 | 32.1 | TYR (Y) | TAC | 42 | 97.7 | 26 | 60.5 | 59.4 |
| HIS (H) | CAC | 25 | 83.3 | 15 | 50.0 | 49.6 | | TAT | 1 | 2.3 | 17 | 39.5 | 40.6 |
| | CAT | 5 | 16.7 | 15 | 50.0 | 50.4 | VAL (V) | GTA | 0 | 0.0 | 0 | 0.0 | 0.0 |
| ILE (I) | ATA | 0 | 0.0 | 29 | 21.0 | 21.1 | | GTC | 176 | 70.7 | 67 | 26.9 | 27.0 |
| | ATC | 99 | 71.7 | 59 | 42.8 | 42.7 | | GTG | 39 | 15.7 | 79 | 31.7 | 31.7 |
| | ATT | 39 | 28.3 | 50 | 36.2 | 36.2 | | GTT | 34 | 13.7 | 103 | 41.4 | 41.3 |
| | Totals | 1566 | | 1566 | | | | Totals | 1345 | | 1345 | | |

TABLE 4

PUFA OrfB codon compositions

| Amino Acid | Codon | Original Gene # | Original Gene % | Plnt Opt Gene # | Plnt Opt Gene % | Plnt Opt Recm'd | Amino Acid | Codon | Original Gene # | Original Gene % | Plnt Opt Gene # | Plnt Opt Gene % | Plnt Opt Recm'd |
|---|---|---|---|---|---|---|---|---|---|---|---|---|---|
| ALA (A) | GCA | 13 | 5.7 | 53 | 23.2 | 23.3 | LEU (L) | CTA | 0 | 0.0 | 0 | 0.0 | 0.0 |
|  | GCC | 135 | 59.2 | 48 | 21.1 | 21.2 |  | CTC | 116 | 63.0 | 51 | 27.7 | 28.5 |
|  | GCG | 43 | 18.9 | 34 | 14.9 | 14.2 |  | CTG | 21 | 11.4 | 27 | 14.7 | 14.6 |
|  | GCT | 37 | 16.2 | 93 | 40.8 | 41.3 |  | CTT | 44 | 23.9 | 59 | 32.1 | 31.6 |
| ARG (R) | AGA | 0 | 0.0 | 54 | 45.0 | 43.8 |  | TTA | 0 | 0.0 | 0 | 0.0 | 0.0 |
|  | AGG | 0 | 0.0 | 36 | 30.0 | 30.5 |  | TTG | 3 | 1.6 | 47 | 25.5 | 25.3 |
|  | CGA | 1 | 0.8 | 0 | 0.0 | 0.0 | LYS (K) | AAA | 10 | 8.8 | 52 | 45.6 | 44.6 |
|  | CGC | 95 | 79.2 | 0 | 0.0 | 0.0 |  | AAG | 104 | 91.2 | 62 | 54.4 | 55.4 |
|  | CGG | 1 | 0.8 | 0 | 0.0 | 0.0 | MET (M) | ATG | 45 | 100 | 45 | 100 | 100.0 |
|  | CGT | 23 | 19.2 | 30 | 25.0 | 25.7 | PHE (F) | TTC | 33 | 47.8 | 41 | 59.4 | 58.6 |
| ASN (N) | AAC | 75 | 89.3 | 51 | 60.7 | 62.6 |  | TTT | 36 | 52.2 | 28 | 40.6 | 41.4 |
|  | AAT | 9 | 10.7 | 33 | 39.3 | 37.4 | PRO (P) | CCA | 8 | 7.2 | 33 | 29.7 | 29.6 |
| ASP (D) | GAC | 86 | 72.3 | 52 | 43.7 | 42.5 |  | CCC | 47 | 42.3 | 16 | 14.4 | 14.6 |
|  | GAT | 33 | 27.7 | 67 | 56.3 | 57.5 |  | CCG | 35 | 31.5 | 20 | 18.0 | 18.4 |
| CYS (C) | TGC | 41 | 100.0 | 20 | 48.8 | 49.2 |  | CCT | 21 | 18.9 | 42 | 37.8 | 37.3 |
|  | TGT | 0 | 0.0 | 21 | 51.2 | 50.8 | SER (S) | AGC | 40 | 26.5 | 28 | 18.5 | 17.9 |
| END | TAA | 1 | 100.0 | 0 | 0.0 | 0.0 |  | AGT | 7 | 4.6 | 24 | 15.9 | 15.8 |
|  | TAG | 0 | 0.0 | 0 | 0.0 | 0.0 |  | TCA | 2 | 1.3 | 31 | 20.5 | 20.4 |
|  | TGA | 0 | 0.0 | 1 | 100.0 | 100.0 |  | TCC | 55 | 36.4 | 28 | 18.5 | 18.7 |
| GLN (Q) | CAA | 8 | 13.6 | 30 | 50.8 | 50.0 |  | TCG | 33 | 21.9 | 0 | 0.0 | 0.0 |
|  | CAG | 51 | 86.4 | 29 | 49.2 | 50.0 |  | TCT | 14 | 9.3 | 40 | 26.5 | 27.2 |
| GLU (E) 16 | GAA | 33 | 24.8 | 58 | 43.6 | 43.6 | THR (T) | ACA | 8 | 8.1 | 28 | 28.3 | 26.3 |
|  | GAG | 100 | 75.2 | 75 | 56.4 | 56.4 |  | ACC | 58 | 58.6 | 24 | 24.2 | 26.9 |
| GLY (G) | GGA | 11 | 7.2 | 55 | 36.2 | 36.4 |  | ACG | 26 | 26.3 | 16 | 16.2 | 16.9 |
|  | GGC | 102 | 67.1 | 25 | 16.4 | 16.2 |  | ACT | 7 | 7.1 | 31 | 31.3 | 30.0 |
|  | GGG | 3 | 2.0 | 23 | 15.1 | 15.2 | TRP (W) | TGG | 22 | 100 | 22 | 100 | 100.0 |
|  | GGT | 36 | 23.7 | 49 | 32.2 | 32.1 | TYR (Y) | TAC | 51 | 91.1 | 32 | 57.1 | 59.4 |
| HIS (H) | CAC | 29 | 76.3 | 19 | 50.0 | 49.6 |  | TAT | 5 | 8.9 | 24 | 42.9 | 40.6 |
|  | CAT | 9 | 23.7 | 19 | 50.0 | 50.4 | VAL (V) | GTA | 1 | 0.8 | 0 | 0.0 | 0.0 |
| ILE (I) | ATA | 0 | 0.0 | 22 | 21.2 | 21.1 |  | GTC | 85 | 65.4 | 34 | 26.2 | 27.0 |
|  | ATC | 67 | 64.4 | 44 | 42.3 | 42.7 |  | GTG | 30 | 23.1 | 42 | 32.3 | 31.7 |
|  | ATT | 37 | 35.6 | 38 | 36.5 | 36.2 |  | GTT | 14 | 10.8 | 54 | 41.5 | 41.3 |
|  | Totals | 1079 |  | 1079 |  |  |  | Totals | 981 |  | 981 |  |  |

TABLE 5

PUFA chimeric OrfC codon compositions

| Amino Acid | Codon | Original Gene # | Original Gene % | Plnt Opt Gene # | Plnt Opt Gene % | Plnt Opt Recm'd | Amino Acid | Codon | Original Gene # | Original Gene % | Plnt Opt Gene # | Plnt Opt Gene % | Plnt Opt Recm'd |
|---|---|---|---|---|---|---|---|---|---|---|---|---|---|
| ALA (A) | GCA | 18 | 14.0 | 30 | 23.3 | 23.3 | LEU (L) | CTA | 2 | 1.6 | 0 | 0.0 | 0.0 |
|  | GCC | 84 | 65.1 | 28 | 21.7 | 21.2 |  | CTC | 78 | 63.9 | 34 | 27.9 | 28.5 |
|  | GCG | 14 | 10.9 | 19 | 14.7 | 14.2 |  | CTG | 18 | 14.8 | 18 | 14.8 | 14.6 |
|  | GCT | 13 | 10.1 | 52 | 40.3 | 41.3 |  | CTT | 16 | 13.1 | 39 | 32.0 | 31.6 |
| ARG (R) | AGA | 1 | 1.3 | 33 | 44.0 | 43.8 |  | TTA | 1 | 0.8 | 0 | 0.0 | 0.0 |
|  | AGG | 1 | 1.3 | 23 | 30.7 | 30.5 |  | TTG | 7 | 5.7 | 31 | 25.4 | 25.3 |
|  | CGA | 6 | 8.0 | 0 | 0.0 | 0.0 | LYS (K) | AAA | 15 | 16.1 | 42 | 45.2 | 44.6 |
|  | CGC | 53 | 70.7 | 0 | 0.0 | 0.0 |  | AAG | 78 | 83.9 | 51 | 54.8 | 55.4 |
|  | CGG | 3 | 4.0 | 0 | 0.0 | 0.0 | MET (M) | ATG | 48 | 100 | 48 | 100 | 100.0 |
|  | CGT | 11 | 14.7 | 19 | 25.3 | 25.7 | PHE (F) | TTC | 40 | 58.8 | 40 | 58.8 | 58.6 |
| ASN (N) | AAC | 63 | 90.0 | 43 | 61.4 | 62.6 |  | TTT | 28 | 41.2 | 28 | 41.2 | 41.4 |
|  | AAT | 7 | 10.0 | 27 | 38.6 | 37.4 | PRO (P) | CCA | 10 | 11.2 | 27 | 30.3 | 29.6 |
| ASP (D) | GAC | 70 | 76.9 | 40 | 44.0 | 42.5 |  | CCC | 35 | 39.3 | 13 | 14.6 | 14.6 |
|  | GAT | 21 | 23.1 | 51 | 56.0 | 57.5 |  | CCG | 26 | 29.2 | 16 | 18.0 | 18.4 |
| CYS (C) | TGC | 26 | 81.3 | 16 | 50.0 | 49.2 |  | CCT | 18 | 20.2 | 33 | 37.1 | 37.3 |
|  | TGT | 6 | 18.8 | 16 | 50.0 | 50.8 | SER (S) | AGC | 16 | 19.0 | 13 | 15.5 | 17.9 |
| END | TAA | 1 | 100.0 | 0 | 0.0 | 0.0 |  | AGT | 3 | 3.6 | 14 | 16.7 | 15.8 |
|  | TAG | 0 | 0.0 | 0 | 0.0 | 0.0 |  | TCA | 9 | 10.7 | 18 | 21.4 | 20.4 |
|  | TGA | 0 | 0.0 | 1 | 100.0 | 100.0 |  | TCC | 28 | 33.3 | 16 | 19.0 | 18.7 |
| GLN (Q) | CAA | 11 | 24.4 | 25 | 55.6 | 50.0 |  | TCG | 21 | 25.0 | 0 | 0.0 | 0.0 |
|  | CAG | 34 | 75.6 | 20 | 44.4 | 50.0 |  | TCT | 7 | 8.3 | 23 | 27.4 | 27.2 |
| GLU (E) 16 | GAA | 17 | 19.1 | 40 | 44.9 | 43.6 | THR (T) | ACA | 4 | 6.2 | 17 | 26.2 | 26.3 |
|  | GAG | 72 | 80.9 | 49 | 55.1 | 56.4 |  | ACC | 41 | 63.1 | 17 | 26.2 | 26.9 |
| GLY (G) | GGA | 21 | 17.9 | 43 | 36.8 | 36.4 |  | ACG | 8 | 12.3 | 11 | 16.9 | 16.9 |
|  | GGC | 78 | 66.7 | 18 | 15.4 | 16.2 |  | ACT | 12 | 18.5 | 20 | 30.8 | 30.0 |
|  | GGG | 7 | 6.0 | 18 | 15.4 | 15.2 | TRP (W) | TGG | 18 | 100 | 18 | 100 | 100.0 |
|  | GGT | 11 | 9.4 | 38 | 32.5 | 32.1 | TYR (Y) | TAC | 41 | 87.2 | 28 | 59.6 | 59.4 |
| HIS (H) | CAC | 24 | 85.7 | 14 | 50.0 | 49.6 |  | TAT | 6 | 12.8 | 19 | 40.4 | 40.6 |
|  | CAT | 4 | 14.3 | 14 | 50.0 | 50.4 | VAL (V) | GTA | 6 | 5.3 | 0 | 0.0 | 0.0 |

TABLE 5-continued

PUFA chimeric OrfC codon compositions

| Amino Acid | Codon | Original Gene # | Original Gene % | Plnt Opt Gene # | Plnt Opt Gene % | Plnt Opt Recm'd | Amino Acid | Codon | Original Gene # | Original Gene % | Plnt Opt Gene # | Plnt Opt Gene % | Plnt Opt Recm'd |
|---|---|---|---|---|---|---|---|---|---|---|---|---|---|
| ILE (I) | ATA | 0 | 0.0 | 15 | 21.7 | 21.1 | | GTC | 62 | 54.4 | 31 | 27.2 | 27.0 |
| | ATC | 48 | 69.6 | 30 | 43.5 | 42.7 | | GTG | 24 | 21.1 | 37 | 32.5 | 31.7 |
| | ATT | 21 | 30.4 | 24 | 34.8 | 36.2 | | GTT | 22 | 19.3 | 46 | 40.4 | 41.3 |
| | Totals | 746 | | 746 | | | | Totals | 748 | | 748 | | |

TABLE 6

Acyl-CoA synthetase codon compositions

| Amino Acid | Codon | Original Gene # | Original Gene % | Plnt Opt Gene # | Plnt Opt Gene % | Plnt Opt Recm'd | Amino Acid | Codon | Original Gene # | Original Gene % | Plnt Opt Gene # | Plnt Opt Gene % | Plnt Opt Recm'd |
|---|---|---|---|---|---|---|---|---|---|---|---|---|---|
| ALA (A) | GCA | 2 | 2.3 | 21 | 24.7 | 23.3 | LEU (L) | CTA | 0 | 0.0 | 0 | 0.0 | 0.0 |
| | GCC | 59 | 68.6 | 18 | 21.2 | 21.2 | | CTC | 35 | 63.6 | 15 | 27.3 | 28.5 |
| | GCG | 11 | 12.8 | 12 | 14.1 | 14.2 | | CTG | 6 | 10.9 | 9 | 16.4 | 14.6 |
| | GCT | 14 | 16.3 | 34 | 40.0 | 41.3 | | CTT | 13 | 23.6 | 17 | 30.9 | 31.6 |
| ARG (R) | AGA | 0 | 0.0 | 14 | 43.8 | 43.8 | | TTA | 0 | 0.0 | 0 | 0.0 | 0.0 |
| | AGG | 3 | 9.4 | 10 | 31.3 | 30.5 | | TTG | 1 | 1.8 | 14 | 25.5 | 25.3 |
| | CGA | 0 | 0.0 | 0 | 0.0 | 0.0 | LYS (K) | AAA | 2 | 4.1 | 22 | 44.9 | 44.6 |
| | CGC | 25 | 78.1 | 0 | 0.0 | 0.0 | | AAG | 47 | 95.9 | 27 | 55.1 | 55.4 |
| | CGG | 0 | 0.0 | 0 | 0.0 | 0.0 | MET (M) | ATG | 21 | 100 | 21 | 100 | 100.0 |
| | CGT | 4 | 12.5 | 8 | 25.0 | 25.7 | PHE (F) | TTC | 16 | 51.6 | 18 | 58.1 | 58.6 |
| ASN (N) | AAC | 22 | 95.7 | 14 | 60.9 | 62.6 | | TTT | 15 | 48.4 | 13 | 41.9 | 41.4 |
| | AAT | 1 | 4.3 | 9 | 39.1 | 37.4 | PRO (P) | CCA | 0 | 0.0 | 11 | 30.6 | 29.6 |
| ASP (D) | GAC | 38 | 74.5 | 22 | 43.1 | 42.5 | | CCC | 20 | 55.6 | 5 | 13.9 | 14.6 |
| | GAT | 13 | 25.5 | 29 | 56.9 | 57.5 | | CCG | 9 | 25.0 | 7 | 19.4 | 18.4 |
| CYS (C) | TGC | 11 | 91.7 | 6 | 50.0 | 49.2 | | CCT | 7 | 19.4 | 13 | 36.1 | 37.3 |
| | TGT | 1 | 8.3 | 6 | 50.0 | 50.8 | SER (S) | AGC | 7 | 17.5 | 7 | 17.5 | 17.9 |
| END | TAA | 1 | 100.0 | 0 | 0.0 | 0.0 | | AGT | 4 | 10.0 | 6 | 15.0 | 15.8 |
| | TAG | 0 | 0.0 | 0 | 0.0 | 0.0 | | TCA | 1 | 2.5 | 8 | 20.0 | 20.4 |
| | TGA | 0 | 0.0 | 1 | 100.0 | 100.0 | | TCC | 19 | 47.5 | 8 | 20.0 | 18.7 |
| GLN (Q) | CAA | 3 | 18.8 | 8 | 50.0 | 50.0 | | TCG | 7 | 17.5 | 0 | 0.0 | 0.0 |
| | CAG | 13 | 81.3 | 8 | 50.0 | 50.0 | | TCT | 2 | 5.0 | 11 | 27.5 | 27.2 |
| GLU (E) 16 | GAA | 11 | 17.7 | 27 | 43.5 | 43.6 | THR (T) | ACA | 1 | 2.0 | 13 | 25.5 | 26.3 |
| | GAG | 51 | 82.3 | 35 | 56.5 | 56.4 | | ACC | 27 | 52.9 | 14 | 27.5 | 26.9 |
| GLY (G) | GGA | 5 | 7.4 | 25 | 36.8 | 36.4 | | ACG | 19 | 37.3 | 9 | 17.6 | 16.9 |
| | GGC | 49 | 72.1 | 11 | 16.2 | 16.2 | | ACT | 4 | 7.8 | 15 | 29.4 | 30.0 |
| | GGG | 0 | 0.0 | 10 | 14.7 | 15.2 | TRP (W) | TGG | 10 | 100 | 10 | 100 | 100.0 |
| | GGT | 14 | 20.6 | 22 | 32.4 | 32.1 | TYR (Y) | TAC | 18 | 85.7 | 12 | 57.1 | 59.4 |
| HIS (H) | CAC | 10 | 83.3 | 6 | 50.0 | 49.6 | | TAT | 3 | 14.3 | 9 | 42.9 | 40.6 |
| | CAT | 2 | 16.7 | 6 | 50.0 | 50.4 | VAL (V) | GTA | 0 | 0.0 | 0 | 0.0 | 0.0 |
| ILE (I) | ATA | 0 | 0.0 | 10 | 21.3 | 21.1 | | GTC | 34 | 58.6 | 16 | 27.6 | 27.0 |
| | ATC | 27 | 57.4 | 20 | 42.6 | 42.7 | | GTG | 9 | 15.5 | 19 | 32.8 | 31.7 |
| | ATT | 20 | 42.6 | 17 | 36.2 | 36.2 | | GTT | 15 | 25.9 | 23 | 39.7 | 41.3 |
| | Totals | 410 | | 409 | | | | Totals | 372 | | 372 | | |

TABLE 7

Phosphopantetheinyl transferase HetI codon compositions

| Amino Acid | Codon | Original Gene # | Original Gene % | Plnt Opt Gene # | Plnt Opt Gene % | Plnt Opt Recm'd | Amino Acid | Codon | Original Gene # | Original Gene % | Plnt Opt Gene # | Plnt Opt Gene % | Plnt Opt Recm'd |
|---|---|---|---|---|---|---|---|---|---|---|---|---|---|
| ALA (A) | GCA | 4 | 20.0 | 5 | 25.0 | 23.3 | LEU (L) | CTA | 6 | 17.1 | 0 | 0.0 | 0.0 |
| | GCC | 6 | 30.0 | 4 | 20.0 | 21.2 | | CTC | 4 | 11.4 | 10 | 28.6 | 28.5 |
| | GCG | 2 | 10.0 | 3 | 15.0 | 14.2 | | CTG | 0 | 0.0 | 5 | 14.3 | 14.6 |
| | GCT | 8 | 40.0 | 8 | 40.0 | 41.3 | | CTT | 3 | 8.6 | 11 | 31.4 | 31.6 |
| ARG (R) | AGA | 1 | 6.3 | 6 | 37.5 | 43.8 | | TTA | 14 | 40.0 | 0 | 0.0 | 0.0 |
| | AGG | 1 | 6.3 | 5 | 31.3 | 30.5 | | TTG | 8 | 22.9 | 9 | 25.7 | 25.3 |
| | CGA | 2 | 12.5 | 0 | 0.0 | 0.0 | LYS (K) | AAA | 10 | 90.9 | 5 | 45.5 | 44.6 |
| | CGC | 6 | 37.5 | 0 | 0.0 | 0.0 | | AAG | 1 | 9.1 | 6 | 54.5 | 55.4 |
| | CGG | 1 | 6.3 | 0 | 0.0 | 0.0 | MET (M) | ATG | 1 | 100 | 1 | 100 | 100.0 |
| | CGT | 5 | 31.3 | 5 | 31.3 | 25.7 | PHE (F) | TTC | 3 | 25.0 | 6 | 50.0 | 58.6 |

TABLE 7-continued

Phosphopantetheinyl transferase HetI codon compositions

| Amino Acid | Codon | Original Gene # | Original Gene % | Plnt Opt Gene # | Plnt Opt Gene % | Plnt Opt Recm'd | Amino Acid | Codon | Original Gene # | Original Gene % | Plnt Opt Gene # | Plnt Opt Gene % | Plnt Opt Recm'd |
|---|---|---|---|---|---|---|---|---|---|---|---|---|---|
| ASN (N) | AAC | 3 | 50.0 | 4 | 66.7 | 62.6 | | TTT | 9 | 75.0 | 6 | 50.0 | 41.4 |
| | AAT | 3 | 50.0 | 2 | 33.3 | 37.4 | PRO (P) | CCA | 9 | 56.3 | 5 | 31.3 | 29.6 |
| ASP (D) | GAC | 3 | 25.0 | 5 | 41.7 | 42.5 | | CCC | 6 | 37.5 | 2 | 12.5 | 14.6 |
| | GAT | 9 | 75.0 | 7 | 58.3 | 57.5 | | CCG | 1 | 6.3 | 3 | 18.8 | 18.4 |
| CYS (C) | TGC | 0 | 0.0 | 1 | 33.3 | 49.2 | | CCT | 0 | 0.0 | 6 | 37.5 | 37.3 |
| | TGT | 3 | 100.0 | 2 | 66.7 | 50.8 | SER (S) | AGC | 0 | 0.0 | 2 | 15.4 | 17.9 |
| END | TAA | 0 | 0.0 | 0 | 0.0 | 0.0 | | AGT | 4 | 30.8 | 2 | 15.4 | 15.8 |
| | TAG | 0 | 0.0 | 0 | 0.0 | 0.0 | | TCA | 3 | 23.1 | 3 | 23.1 | 20.4 |
| | TGA | 1 | 100.0 | 1 | 100.0 | 100.0 | | TCC | 3 | 23.1 | 2 | 15.4 | 18.7 |
| GLN (Q) | CAA | 5 | 45.5 | 5 | 45.5 | 50.0 | | TCG | 1 | 7.7 | 0 | 0.0 | 0.0 |
| | CAG | 6 | 54.5 | 6 | 54.5 | 50.0 | | TCT | 2 | 15.4 | 4 | 30.8 | 27.2 |
| GLU (E) 16 | GAA | 13 | 72.2 | 8 | 44.4 | 43.6 | THR (T) | ACA | 3 | 27.3 | 3 | 27.3 | 26.3 |
| | GAG | 5 | 27.8 | 10 | 55.6 | 56.4 | | ACC | 2 | 18.2 | 3 | 27.3 | 26.9 |
| GLY (G) | GGA | 0 | 0.0 | 5 | 35.7 | 36.4 | | ACG | 2 | 18.2 | 2 | 18.2 | 16.9 |
| | GGC | 5 | 35.7 | 2 | 14.3 | 16.2 | | ACT | 4 | 36.4 | 3 | 27.3 | 30.0 |
| | GGG | 2 | 14.3 | 2 | 14.3 | 15.2 | TRP (W) | TGG | 6 | 100 | 6 | 100 | 100.0 |
| | GGT | 7 | 50.0 | 5 | 35.7 | 32.1 | TYR (Y) | TAC | 2 | 22.2 | 5 | 55.6 | 59.4 |
| HIS (H) | CAC | 1 | 20.0 | 3 | 60.0 | 49.6 | | TAT | 7 | 77.8 | 4 | 44.4 | 40.6 |
| | CAT | 4 | 80.0 | 2 | 40.0 | 50.4 | VAL (V) | GTA | 0 | 0.0 | 0 | 0.0 | 0.0 |
| ILE (I) | ATA | 2 | 20.0 | 3 | 30.0 | 21.1 | | GTC | 1 | 12.5 | 2 | 25.0 | 27.0 |
| | ATC | 4 | 40.0 | 4 | 40.0 | 42.7 | | GTG | 3 | 37.5 | 3 | 37.5 | 31.7 |
| | ATT | 4 | 40.0 | 3 | 30.0 | 36.2 | | GTT | 4 | 50.0 | 3 | 37.5 | 41.3 |
| | Totals | 116 | | 116 | | | | Totals | 122 | | 122 | | |

After the codon optimization of the coding region sequences were completed, additional nucleotide sequences were added to the optimized coding region sequence. Restriction sites for the facilitation of cloning, a Kozak sequence and additional stop codons were added to the plant optimized coding sequence. In addition, a second series of PUFA synthase OrfA, PUFA synthase OrfB, PUFA synthase chimeric OrfC, acyl-CoA synthetase and phosphopantetheinyl transferase HetI coding sequences were designed, which contained a chloroplast targeting sequence from the *Arabidopsis thaliana* Ribulose Bisphosphate Carboxylase small chain 1A (GenBank ID: NM 202369.2). This sequence, SEQ ID NO:28, was added to the previously described coding sequences for PUFA synthase OrfA, PUFA synthase OrfB, PUFA synthase chimeric OrfC and phosphopantetheinyl transferase HetI. The initial Methionine from SEQ ID NO:6, SEQ ID NO:7, SEQ ID NO:8 and SEQ ID NO:10 was removed and replaced with the chloroplast targeting sequence. The sequences that contain the chloroplast targeting sequence are identified as version 4 (v4) throughout the specification.

A second chloroplast transit peptide was added to the PUFA synthase OrfA, PUFA synthase OrfB, PUFA synthase chimeric OrfC, acyl-CoA synthetase and phosphopantetheinyl transferase HetI coding sequences. These coding sequences were designed to contain a chloroplast targeting sequence from acyl-ACP-thioesterase (GenBank ID: X73849.1). This sequence, SEQ ID NO:29, was added to the previously described coding sequences for PUFA synthase OrfA, PUFA synthase OrfB, PUFA synthase chimeric OrfC and phosphopantetheinyl transferase HetI. The initial Methionine from SEQ ID NO:6, SEQ ID NO:7, SEQ ID NO:8 and SEQ ID NO:10 was removed and replaced with the chloroplast targeting sequence. The sequences that contain the chloroplast targeting sequence are identified as version 5 (v5) throughout the specification.

An alternative version of the acyl-CoA synthetase gene from *Schizochytrium* sp. was created by modifying the native gene sequence to remove superfluous open reading frames. This version was labeled as "SzACS-2 v4" and listed as SEQ ID NO:30. The resulting gene is used to replace the acyl-CoA synthetase expression gene sequence, described above as "SzACS-2 v3."

Once a plant-optimized DNA sequence has been designed on paper or in silico, actual DNA molecules can be synthesized in the laboratory to correspond in sequence precisely to the designed sequence. Such synthetic DNA molecules can be cloned and otherwise manipulated exactly as if they were derived from natural or native sources. Synthesis of DNA fragments comprising SEQ ID NO:6, SEQ ID NO:7, SEQ ID NO:8, SEQ ID NO:9 and SEQ ID NO:10 containing the additional sequences described above were performed by commercial suppliers (Geneart Ag, Regensburg, Germany). The synthetic DNA was then cloned into expression vectors and transformed into *Agrobacterium* and soybean as described in Examples 2 and 3.

Example 2

Plasmid Construction for pDAB7362

The pDAB7362 binary plasmid (FIG. 2; SEQ ID NO:11) was constructed using a multi-site Gateway L-R recombination reaction. pDAB7362 contains three PUFA synthase PTUs (which express the PUFA synthase OrfA, PUFA synthase OrfB, PUFA synthase chimeric OrfC genes described above), one acyl-CoA synthetase PTU, one phosphopantetheinyl transferase HetI PTU and a phosphinothricin acetyl transferase PTU. Specifically, the first PUFA synthase PTU contains a truncated *Phaseolus vulgaris* phytohemagglutinin-L gene promoter (PvDlec2 promoter v2; GenBank Accession Number X06336), *Arabidopsis thaliana* AT2S3 gene 5' untranslated region (2S 5' UTR; GenBank Accession Number NM_118850), *Schizochytrium* sp. Polyunsaturated Fatty Acid synthase Open Reading Frame A (SzPUFA OrfA v3) and *Arabidopsis thaliana* 2S albumin gene 3' untranslated region terminator (At2S SSP terminator v1; GenBank Accession Number M22035). The second PUFA synthase PTU contains the PvDlec2 promoter v2, 2S 5' UTR, *Schizochytrium* sp. Polyunsaturated Fatty Acid synthase Open Reading Frame B (SzPUFA OrfB v3) and At2S SSP terminator v1. The third PUFA synthase PTU contains the PvDlec2 promoter v2, 2S 5' UTR, *Schizochytrium* and *Thraustochytrium* sp. Polyunsaturated Fatty Acid synthase Open Reading Frame C (hSzThPUFA OrfC v3) and At2S SSP terminator v1. The acyl-CoA synthetase PTU contains the PvDlec2 promoter v2, 2S 5' UTR, *Schizochytrium* sp. acyl-CoA synthetase (SzACS-2 v3) and At2S SSP terminator v1. The phosphopantetheinyl transferase PTU contains the PvDlec2 promoter v2, 2S 5' UTR, *Nostoc* sp. 4' phosphopantetheinyl transferase HetI (No HetI v3) and At2S SSP terminator v1.

Plasmids pDAB7334, pDAB7335, pDAB7336, pDAB7339 and pDAB7333 were recombined to form pDAB7362. Specifically, the five PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, SzACS-2 v3, NoHetI v3. pDAB7333 also contains the phosphinothricin acetyl transferase PTU: Cassava vein Mosaic Virus Promoter (CsVMV promoter v2; Verdaguer et al., *Plant Molecular Biology* 31:1129-1139; 1996), phosphinothricin acetyl transferase (PAT v5; Wohlleben et al., *Gene* 70:25-37; 1988) and *Agrobacterium tumefaciens* ORF1 3' untranslated region (AtuORF1 3' UTR v4; Huang et al., *J. Bacteriol.* 172:1814-1822; 1990), in addition to other regulatory elements such as Overdrive (Toro et al., *PNAS* 85(22): 8558-8562; 1988) and T-strand border sequences (T-DNA Border A and T-DNA Border B; Gardner et al., Science 231:725-727; 1986 and International Publication No. WO 2001/025459 A1). Recombinant plasmids containing the five PTUs were then isolated and tested for incorporation of the five PTUs with restriction enzyme digestion and DNA sequencing.

Example 2.1

Construction of Additional Plasmids that Use the PvDlec2 Promoter to Drive Expression Additional constructs were designed and built that use the PvDlec2 promoter to drive expression of the PUFA synthase OrfA, PUFA synthase OrfB, PUFA synthase chimeric OrfC, acyl-CoA synthetase, and 4' phosphopantetheinyl transferase HetI transgenes. Various alterations to these constructs have been made to increase expression levels. These changes include the use of non-codon optimized gene sequences, incorporation of chloroplast transit peptides, and removal of the acyl-CoA synthetase PTU.

The newly constructed plasmids are used to stably transform soybean plants. Transgenic soybean plants are isolated and molecularly characterized. The use of these alternative constructs result in soybean plants that contain greater amounts of DHA and LC-PUFAs. The resulting LC-PUFA accumulation is determined and soybean plants that produce 0.01% to 15% DHA or 0.01% to 15% LC-PUFA are identified.

Example 2.2

Figure 3:
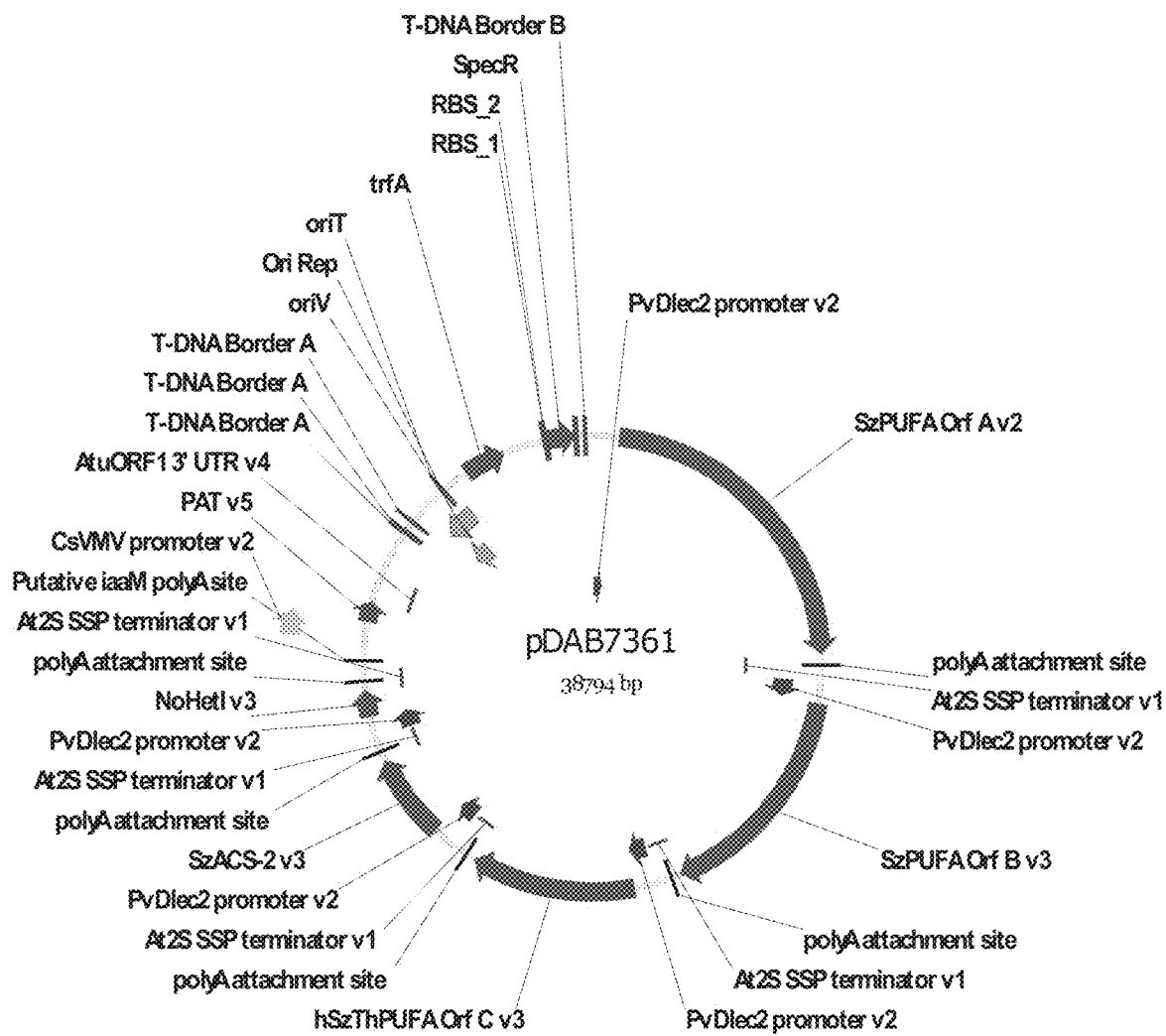
FIG. 3 is a plasmid map of pDAB7361.

Construction of pDAB7361 pDAB7361 is a binary plasmid that was constructed to contain a native, non-codon optimized version of SzPUFA OrfA v2, the remaining gene sequences are codon optimized (SzPUFA OrfB v3, hSzThPUFA OrfC v3, SzACS-2 v3, and NoHetI v3). The pDAB7361 plasmid (FIG. 3; SEQ ID NO:31) was constructed using a multi-site Gateway L-R recombination reaction. pDAB7361 contains three PUFA synthase PTUs, one acyl-CoA synthetase PTU, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v2 and At2S SSP terminator v1. The second PUFA synthase PTU contains the PvDlec2 promoter v2, 2S 5' UTR, SzPUFA OrfB v3 and At2S SSP terminator v1. The third PUFA synthase PTU contains the PvDlec2 promoter v2, 2S 5' UTR, hSzThPUFA OrfC v3 and At2S SSP terminator v1. The acyl-CoA synthetase PTU contains the PvDlec2 promoter v2, 2S 5' UTR, SzACS-2 v3 gene and At2S SSP terminator v1. The phosphopantetheinyl transferase PTU contains the PvDlec2 promoter v2, 2S 5' UTR, NoHetI v3 and At2S SSP terminator v1.

Plasmids pDAB7355, pDAB7335, pDAB7336, pDAB7339 and pDAB7333 were recombined to form pDAB7361. Specifically, the five PTUs described above were placed in a head-to-tail orientation within the T-strand DNA border regions of the plant transformation binary pDAB7333. The order of the genes is: SzPUFA OrfA v2, SzPUFA OrfB v3, hSzThPUFA OrfC v3, SzACS-2 v3 NoHetI v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the six PTUs were then isolated and tested for incorporation of the six PTUs with restriction enzyme digestion and DNA sequencing.

Example 2.3

Figure 4:
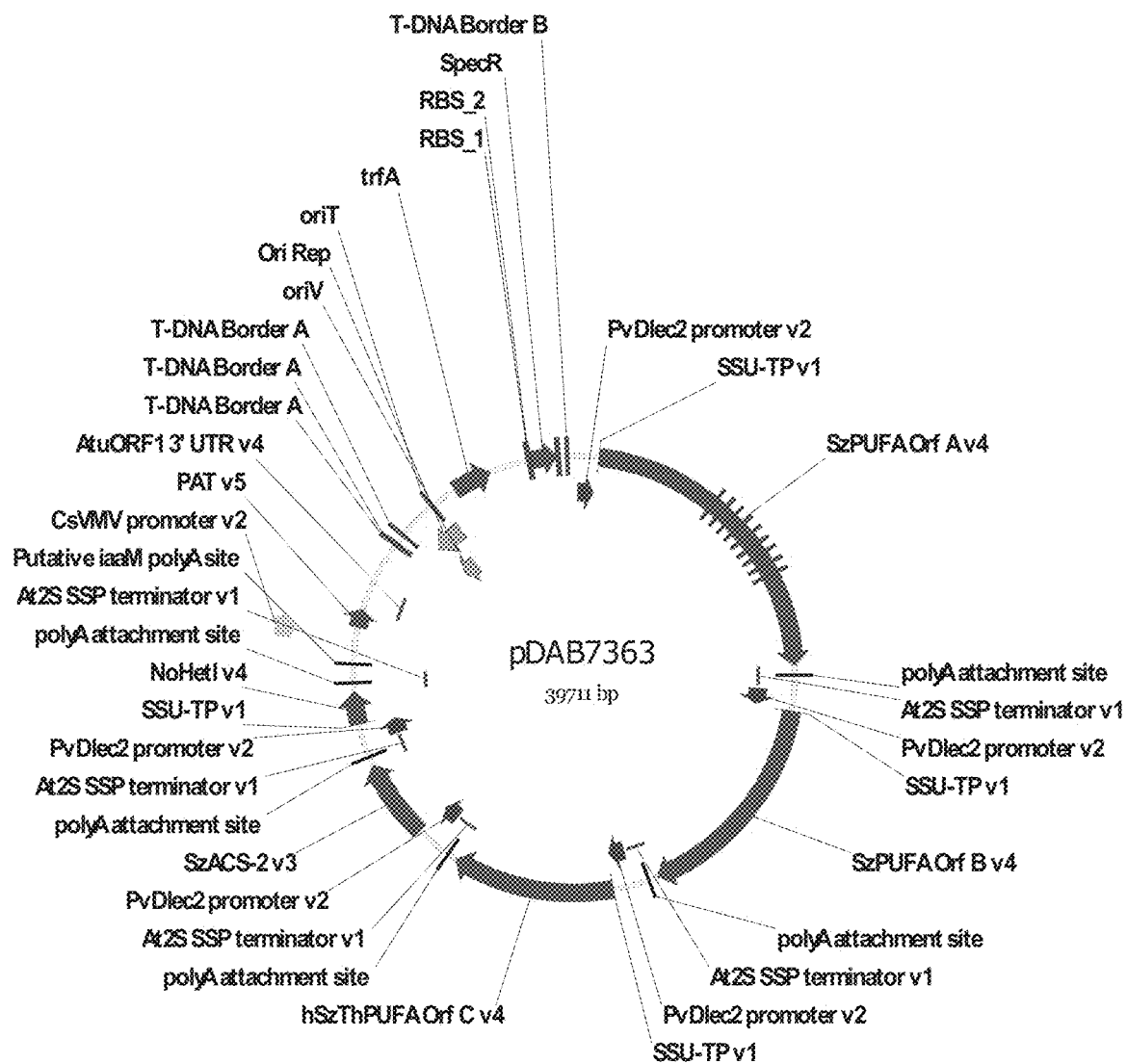
FIG. 4 is a plasmid map of pDAB7363.

Construction of DAB7363 pDAB7363 is a binary plasmid that was constructed to contain rebuilt, codon optimized versions of SzPUFA OrfA v4, SzPUFA OrfB v4, hSzThPUFA OrfC v4, and NoHetI v4 all of which contain the Ribulose Bisphosphate Carboxylase small chain 1A (labeled as SSU-TP v1) that is fused to the amino terminus of the coding sequence. In addition this plasmid contains a rebuilt, codon optimized version of SzACS-2 v3. The pDAB7363 plasmid (FIG. 4; SEQ ID NO:32) was constructed using a multi-site Gateway L-R recombination reaction. pDAB7363 contains three PUFA synthase PTUs, one acyl-CoA synthetase PTU, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v4 and At2S SSP terminator v1. The second PUFA synthase PTU contains the PvDlec2 promoter v2, 2S 5' UTR, SzPUFA OrfB v4 and At2S SSP terminator v1. The third PUFA synthase PTU contains the PvDlec2 promoter v2, 2S 5' UTR, hSzThPUFA OrfC v4 and At2S SSP terminator v1. The acyl-CoA synthetase PTU contains the PvDlec2 promoter v2, 2S 5' UTR, SzACS-2 v3 gene and At2S SSP terminator v1. The phosphopantetheinyl transferase PTU contains the PvDlec2 promoter v2, 2S 5' UTR, NoHetI v4 and At2S SSP terminator v1.

Plasmids pDAB7340, pDAB7341, pDAB7342, pDAB7344 and pDAB7333 were recombined to form pDAB7363. Specifically, the five PTUs described above were placed in a head-to-tail orientation within the T-strand DNA border regions of the plant transformation binary pDAB7333. The order of the genes is: SzPUFA OrfA v4, SzPUFA OrfB v4, hSzThPUFA OrfC v4, SzACS-2 v3, NoHetI v4. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the six PTUs were then isolated and tested for incorporation of the six PTUs with restriction enzyme digestion and DNA sequencing.

Example 2.4

Figure 5:
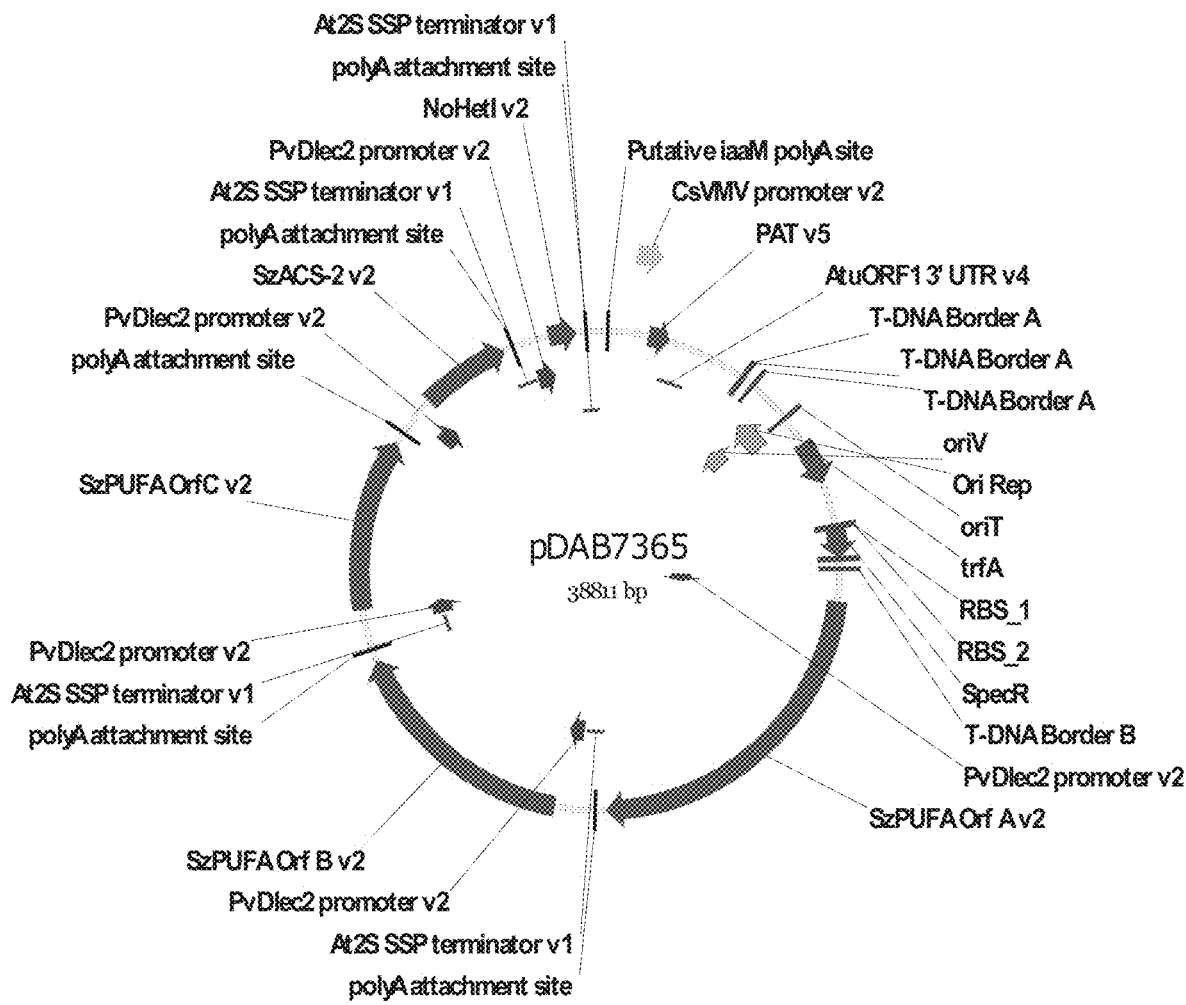
FIG. 5 is a plasmid map of pDAB7365.

Construction of pDAB7365 pDAB7365 is a binary plasmid that was constructed to contain native, non-codon optimized versions of SzPUFA OrfA v2, SzPUFA OrfB v2, hSzThPUFA OrfC v2, SzACS-2 v2, and NoHetI v2. The pDAB7365 plasmid (FIG. 5; SEQ ID NO:33) was constructed using a multi-site Gateway L-R recombination reaction. pDAB7365 contains three PUFA synthase PTUs, one acyl-CoA synthetase PTU, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v2 and At2S SSP terminator v1. The second PUFA synthase PTU contains the PvDlec2 promoter v2, 2S 5' UTR, SzPUFA OrfB v2 and At2S SSP terminator v1. The third PUFA synthase PTU contains the PvDlec2 promoter v2, 2S 5' UTR, SzPUFA OrfC v2 and At2S SSP terminator v1. The acyl-CoA synthetase PTU contains the PvDlec2 promoter v2, 2S 5' UTR, SzACS-2 v2 gene and At2S SSP terminator v1. The phosphopantetheinyl transferase PTU contains the PvDlec2 promoter v2, 2S 5' UTR, NoHetI v2 and At2S SSP terminator v1.

Plasmids pDAB7355, pDAB7356, pDAB7357, pDAB7360 and pDAB7333 were recombined to form pDAB7365. Specifically, the five PTUs described above were placed in a head-to-tail orientation within the T-strand DNA border regions of the plant transformation binary pDAB7333. The order of the genes is: SzPUFA OrfA v2, SzPUFA OrfB v2, SzPUFA OrfC v2, SzACS-2 v2, NoHetI v2. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the six PTUs with restriction enzyme digestion and DNA sequencing.

Example 2.5

Figure 6:
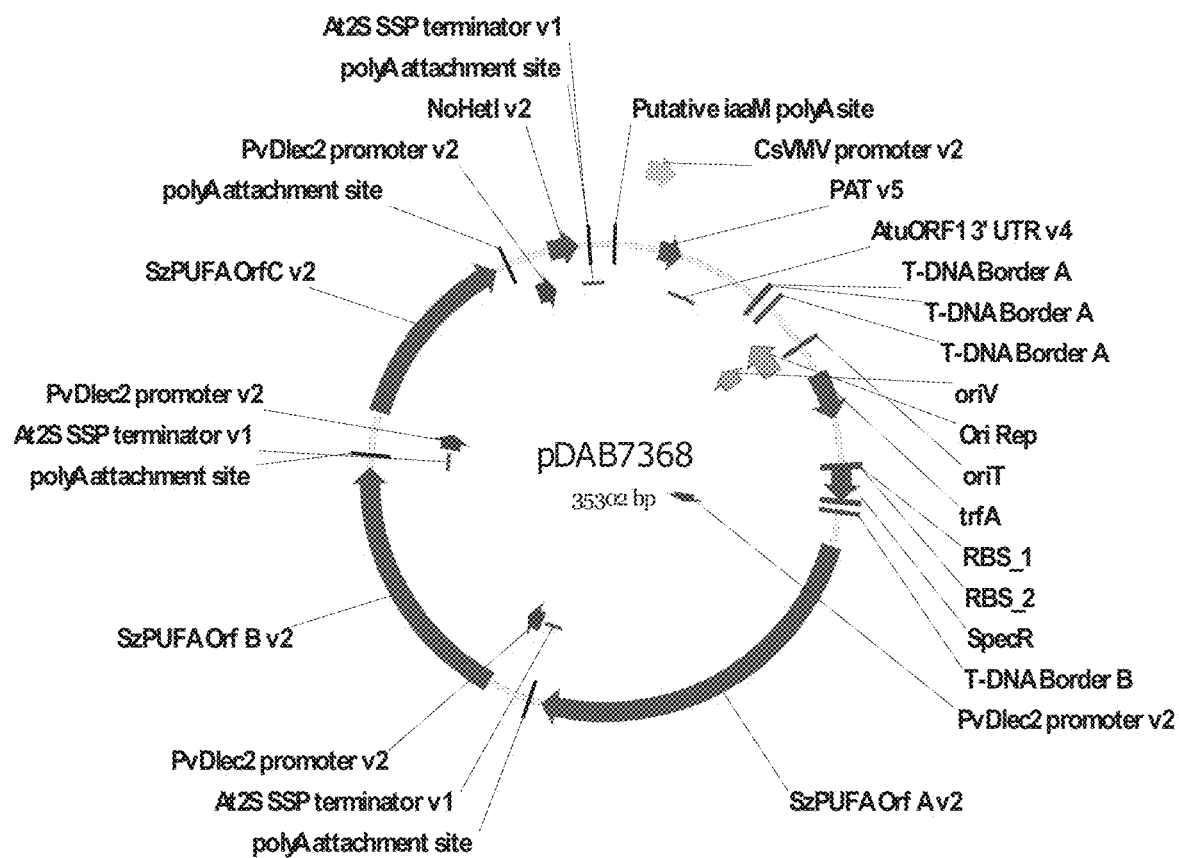
FIG. 6 is a plasmid map of pDAB7368.

Construction of pDAB7368 pDAB7368 is a binary plasmid that was constructed to contain native, non-codon optimized versions of SzPUFA OrfA v2, SzPUFA OrfB v2, hSzThPUFA OrfC v2, and NoHetI v2. This construct does not contain the SzACS-2 coding sequence. The pDAB7368 plasmid (FIG. 6; SEQ ID NO:34) was constructed using a multi-site Gateway L-R recombination reaction. pDAB7368 contains three PUFA synthase PTUs, one acyl-CoA synthetase PTU, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v2 and At2S SSP terminator v1. The second PUFA synthase PTU contains the PvDlec2 promoter v2, 2S 5' UTR, SzPUFA OrfB v2 and At2S SSP terminator v1. The third PUFA synthase PTU contains the PvDlec2 promoter v2, 2S 5' UTR, SzPUFA OrfC v2 and At2S SSP terminator v1. The phosphopantetheinyl transferase PTU contains the PvDlec2 promoter v2, 2S 5' UTR, NoHetI v2 and At2S SSP terminator v1.

Plasmids pDAB7355, pDAB7356, pDAB7357, pDAB7359 and pDAB7333 were recombined to form pDAB7368. Specifically, the four PTUs described above were placed in a head-to-tail orientation within the T-strand DNA border regions of the plant transformation binary pDAB7333. The order of the genes is: SzPUFA OrfA v2, SzPUFA OrfB v2, SzPUFA OrfC v2, NoHetI v2. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the five PTUs with restriction enzyme digestion and DNA sequencing.

Example 2.6

Figure 7:
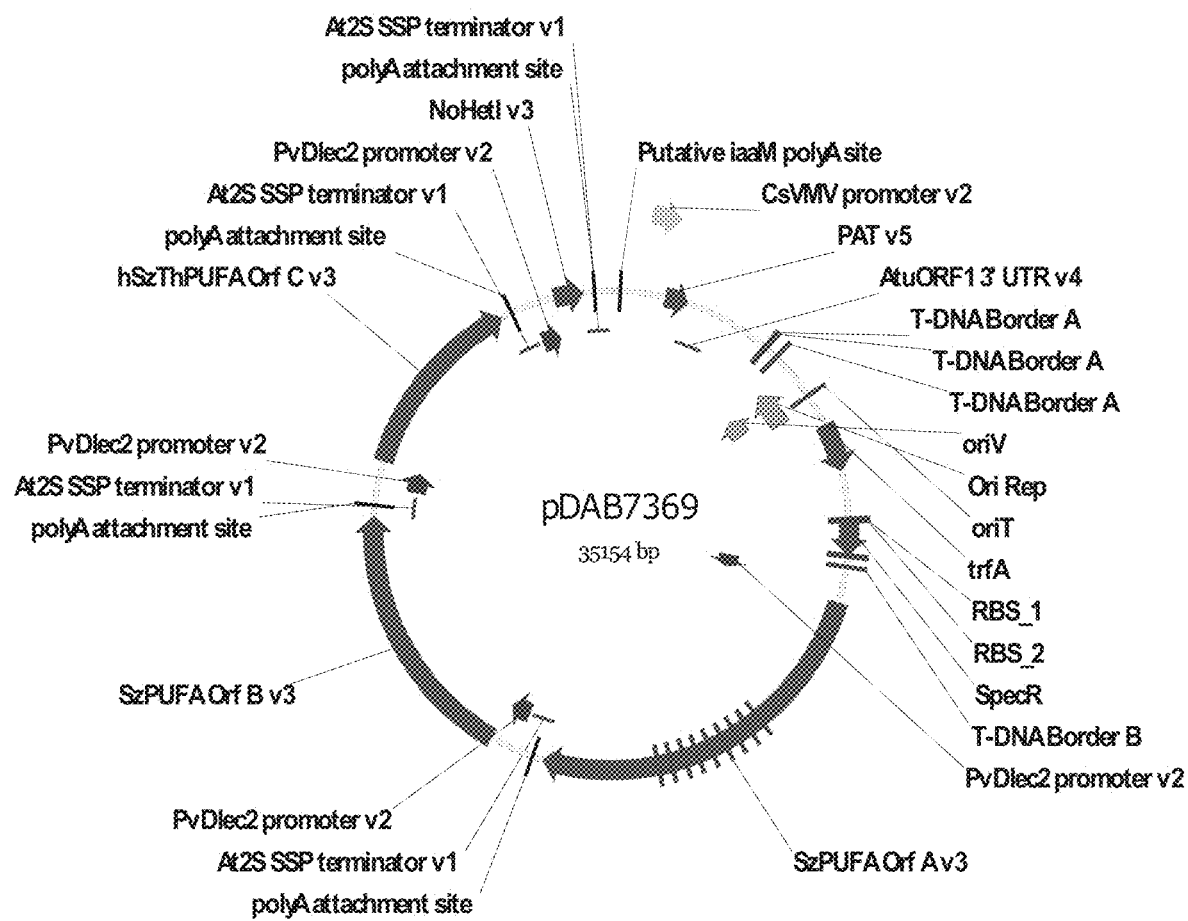
FIG. 7 is a plasmid map of pDAB7369.

Construction of pDAB7369 pDAB7369 is a binary plasmid that was constructed to contain rebuilt, codon optimized versions of SzPUFA OrfA v3, SzPUFA OrfB v3, hSzThPUFA OrfC v3, and NoHetI v3 this construct does not contain the SzACS-2 coding sequence PTU. The pDAB7369 plasmid (FIG. 7; SEQ ID NO:35) was constructed using a multi-site Gateway L-R recombination reaction. pDAB7369 contains three PUFA synthase PTUs, one acyl-CoA synthetase PTU, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The second PUFA synthase PTU contains the PvDlec2 promoter v2, 2S 5' UTR, SzPUFA OrfB v3 and At2S SSP terminator v1. The third PUFA synthase PTU contains the PvDlec2 promoter v2, 2S 5' UTR, hSzThPUFA OrfC v3 and At2S SSP terminator v1. The phosphopantetheinyl transferase PTU contains the PvDlec2 promoter v2, 2S 5' UTR, NoHetI v3 and At2S SSP terminator v1.

Plasmids pDAB7334, pDAB7335, pDAB7336, pDAB7338 and pDAB7333 were recombined to form pDAB7369. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the five PTUs with restriction enzyme digestion and DNA sequencing.

Example 2.7

Figure 8:
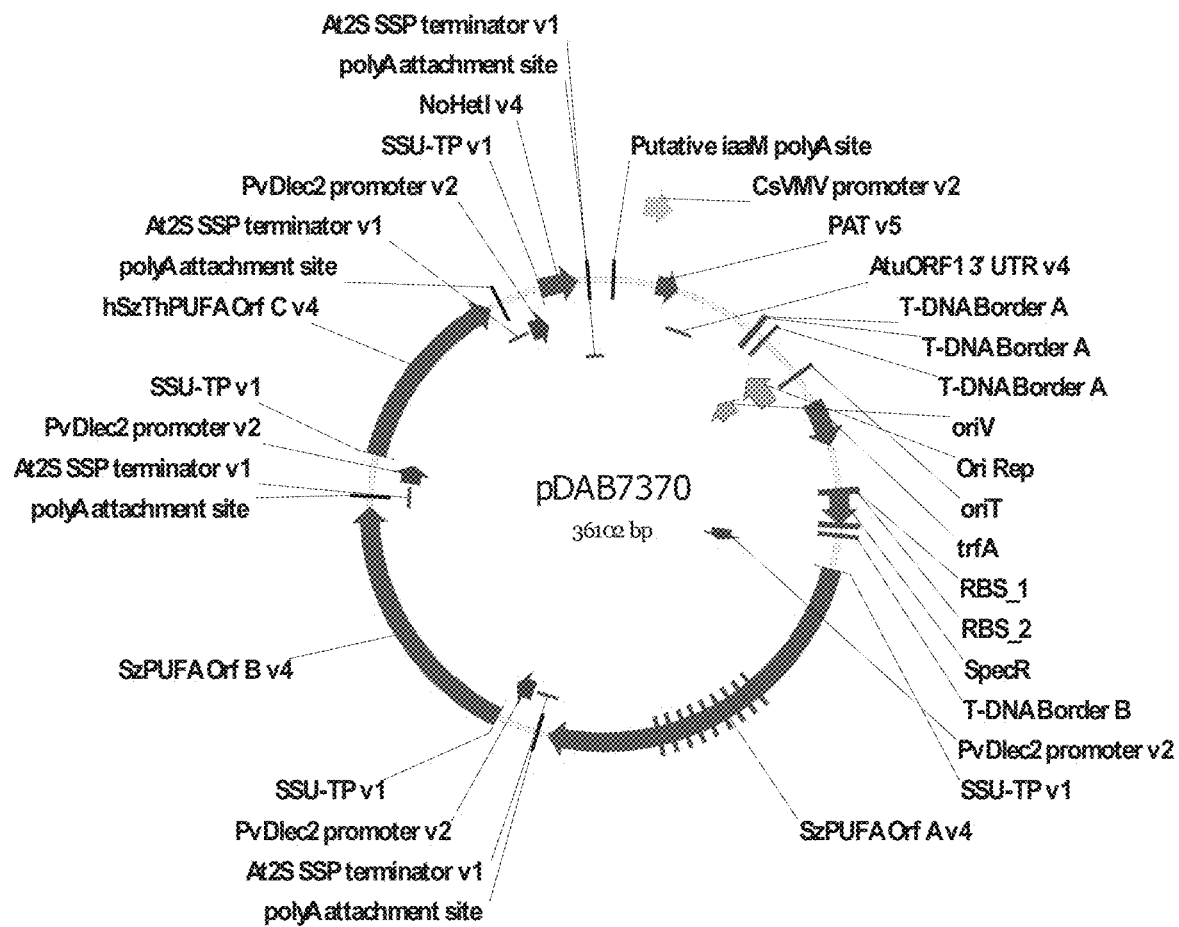
FIG. 8 is a plasmid map of pDAB7370.

Construction of pDAB7370 pDAB7370 is a binary plasmid that was constructed to contain rebuilt, codon optimized versions of SzPUFA OrfA v4, SzPUFA OrfB v4, hSzThPUFA OrfC v4, and NoHetI v4 that contain the Ribulose Bisphosphate Carboxylase small chain 1A (labeled as SSU-TP v1), which is fused to the amino terminus of the coding sequence. This construct does not contain the SzACS-2 coding sequence PTU. The pDAB7370 plasmid (FIG. 8; SEQ ID NO:36) was constructed using a multi-site Gateway L-R recombination reaction. pDAB7370 contains three PUFA synthase PTUs, one acyl-CoA synthetase PTU, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v4 and At2S SSP terminator v1. The second PUFA synthase PTU contains the PvDlec2 promoter v2, 2S 5' UTR, SzPUFA OrfB v4 and At2S SSP terminator v1. The third PUFA synthase PTU contains the PvDlec2 promoter v2, 2S 5' UTR, hSzThPUFA OrfC v4 and At2S SSP terminator v1. The phosphopantetheinyl transferase PTU contains the PvDlec2 promoter v2, 2S 5' UTR, NoHetI v4 and At2S SSP terminator v1.

Plasmids pDAB7340, pDAB7341, pDAB7342, pDAB7343 and pDAB7333 were recombined to form pDAB7370. Specifically, the four PTUs described above were placed in a head-to-tail orientation within the T-strand DNA border regions of the plant transformation binary pDAB7333. The order of the genes is: SzPUFA OrfA v4, SzPUFA OrfB v4, hSzThPUFA OrfC v4, NoHetI v4. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the five PTUs with restriction enzyme digestion and DNA sequencing.

Example 2.8

Figure 9:
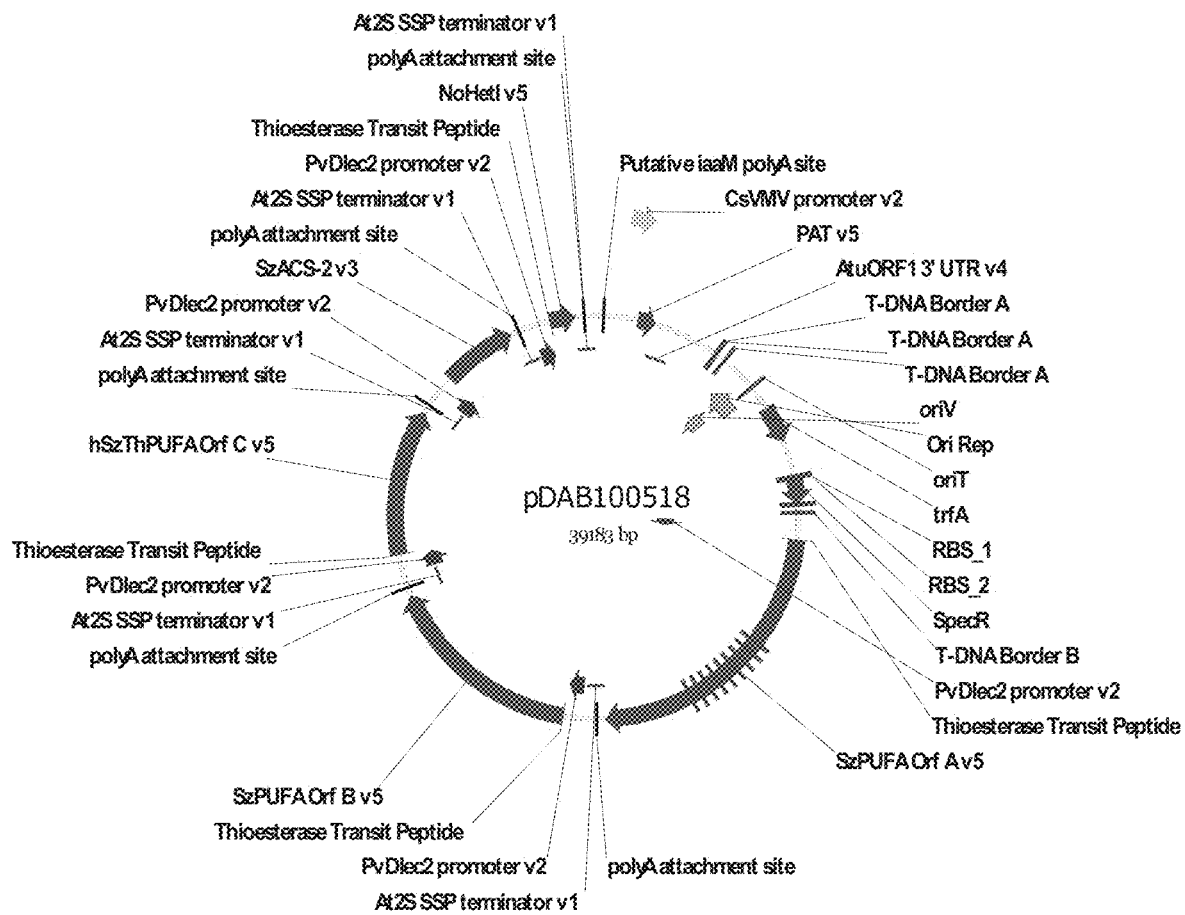
FIG. 9 is a plasmid map of pDAB100518.

Construction of pDAB100518 pDAB100518 is a binary plasmid that was constructed to contain rebuilt, codon optimized versions of SzPUFA OrfA v5, SzPUFA OrfB v5, hSzThPUFA OrfC v5, and NoHetI v5 that contain the chloroplast transit peptide from acyl-ACP-thioesterase (labeled as Thioesterase Transit Peptide), which is fused to the amino terminus of the coding sequence. In addition, the plasmid contains a SzACS-2 v3 coding sequence PTU, which does not possess a chloroplast transit peptide. The pDAB100518 plasmid (FIG. 9; SEQ ID NO:37) was constructed using a multi-site Gateway L-R recombination reaction. pDAB100518 contains three PUFA synthase PTUs, one acyl-CoA synthetase PTU, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v5 and At2S SSP terminator v1. The second PUFA synthase PTU contains the PvDlec2 promoter v2, 2S 5' UTR, SzPUFA OrfB v5 and At2S SSP terminator v1. The third PUFA synthase PTU contains the PvDlec2 promoter v2, 2S 5' UTR, hSzThPUFA OrfC v5 and At2S SSP terminator v1. The acyl-CoA synthetase PTU contains the PvDlec2 promoter v2, 2S 5' UTR, SzACS-2 v3 gene and At2S SSP terminator v1. The phosphopantetheinyl transferase PTU contains the PvDlec2 promoter v2, 2S 5' UTR, NoHetI v5 and At2S SSP terminator v1.

Plasmids pDAB100517, pDAB100514, pDAB100511, pDAB100515 and pDAB7333 were recombined to form pDAB100518. Specifically, the five PTUs described above were placed in a head-to-tail orientation within the T-strand DNA border regions of the plant transformation binary pDAB7333. The order of the genes is: SzPUFA OrfA v5, SzPUFA OrfB v5, hSzThPUFA OrfC v5, SzACS-2 v3, NoHetI v5. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the six PTUs were then isolated and tested for incorporation of the six PTUs with restriction enzyme digestion and DNA sequencing.

Example 2.9

Figure 10:
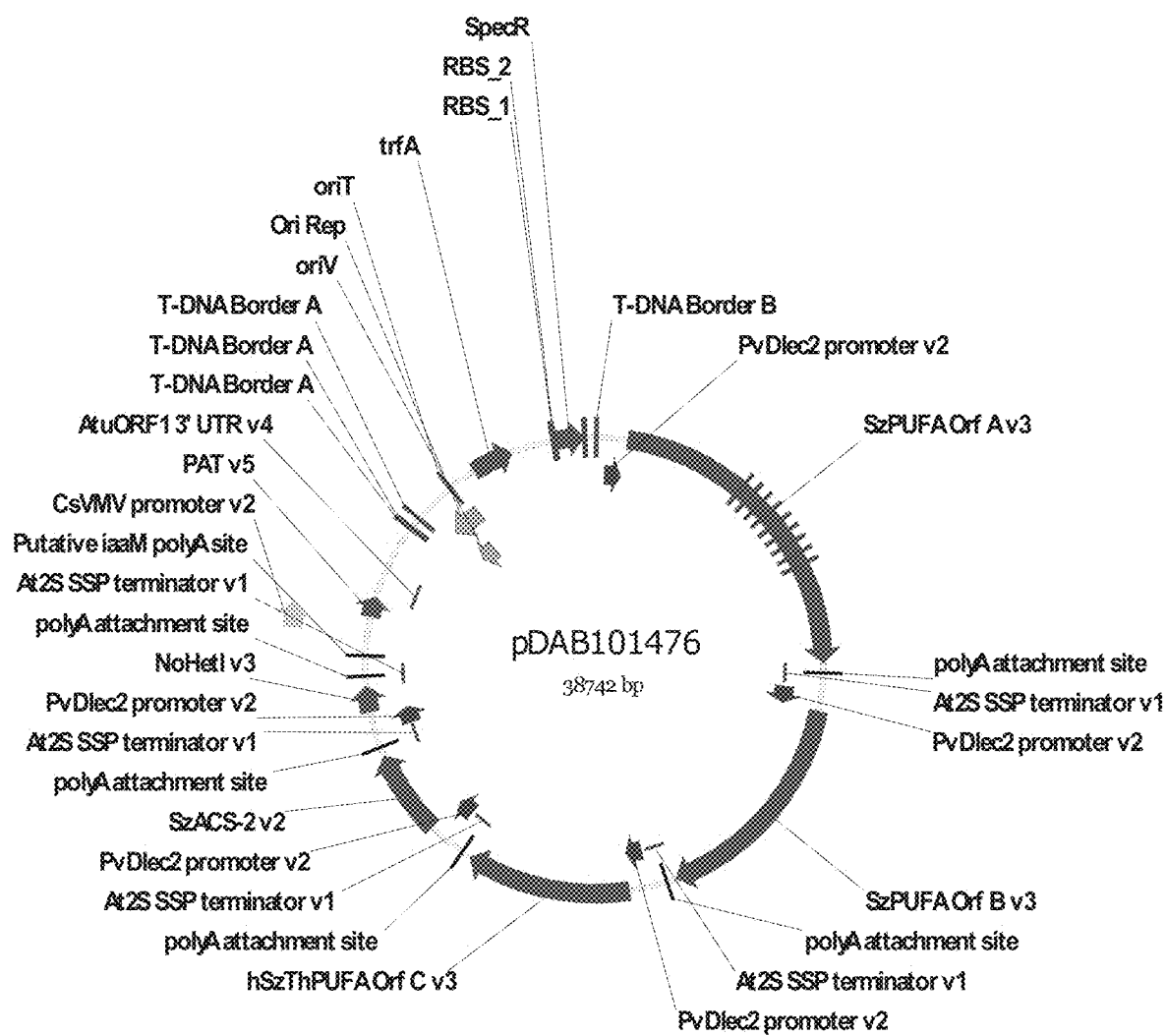
FIG. 10 is a plasmid map of pDAB101476.

Construction of pDAB101476 pDAB101476 is a binary plasmid that was constructed to contain rebuilt, codon optimized versions of SzPUFA OrfA v3, SzPUFA OrfB v3, hSzThPUFA OrfC v3, and NoHetI v3. The SzACS-2 v2 gene sequence is the native, non-codon optimized version. The pDAB101476 plasmid (FIG. 10; SEQ ID NO:38) was constructed using a multi-site Gateway L-R recombination reaction. pDAB101476 contains three PUFA synthase PTUs, one acyl-CoA synthetase PTU, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The second PUFA synthase PTU contains the PvDlec2 promoter v2, 2S 5' UTR, SzPUFA OrfB v3 and At2S SSP terminator v1. The third PUFA synthase PTU contains the PvDlec2 promoter v2, 2S 5' UTR, hSzThPUFA OrfC v3 and At2S SSP terminator v1. The acyl-CoA synthetase PTU contains the PvDlec2 promoter v2, 2S 5' UTR, SzACS-2 v2 gene and At2S SSP terminator v1. The phosphopantetheinyl transferase PTU contains the PvDlec2 promoter v2, 2S 5' UTR, NoHetI v3 and At2S SSP terminator v1.

Plasmids pDAB7334, pDAB7335, pDAB7336, pDAB101471 and pDAB7333 were recombined to form pDAB101476. Specifically, the five PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, SzACS-2 v2, NoHetI v3. pDAB7333 also contains the phosphinothricin acetyl transferase PTU: CsVMV promoter v2, PAT v5. AtuORF1 3' UTR v4 in addition to other regulatory elements such as Overdrive and T-strand border sequences (T-DNA Border A and T-DNA Border B). Recombinant plasmids containing the six PTUs were then isolated and tested for incorporation of the six PTUs with restriction enzyme digestion and DNA sequencing.

Example 2.10

Figure 11:
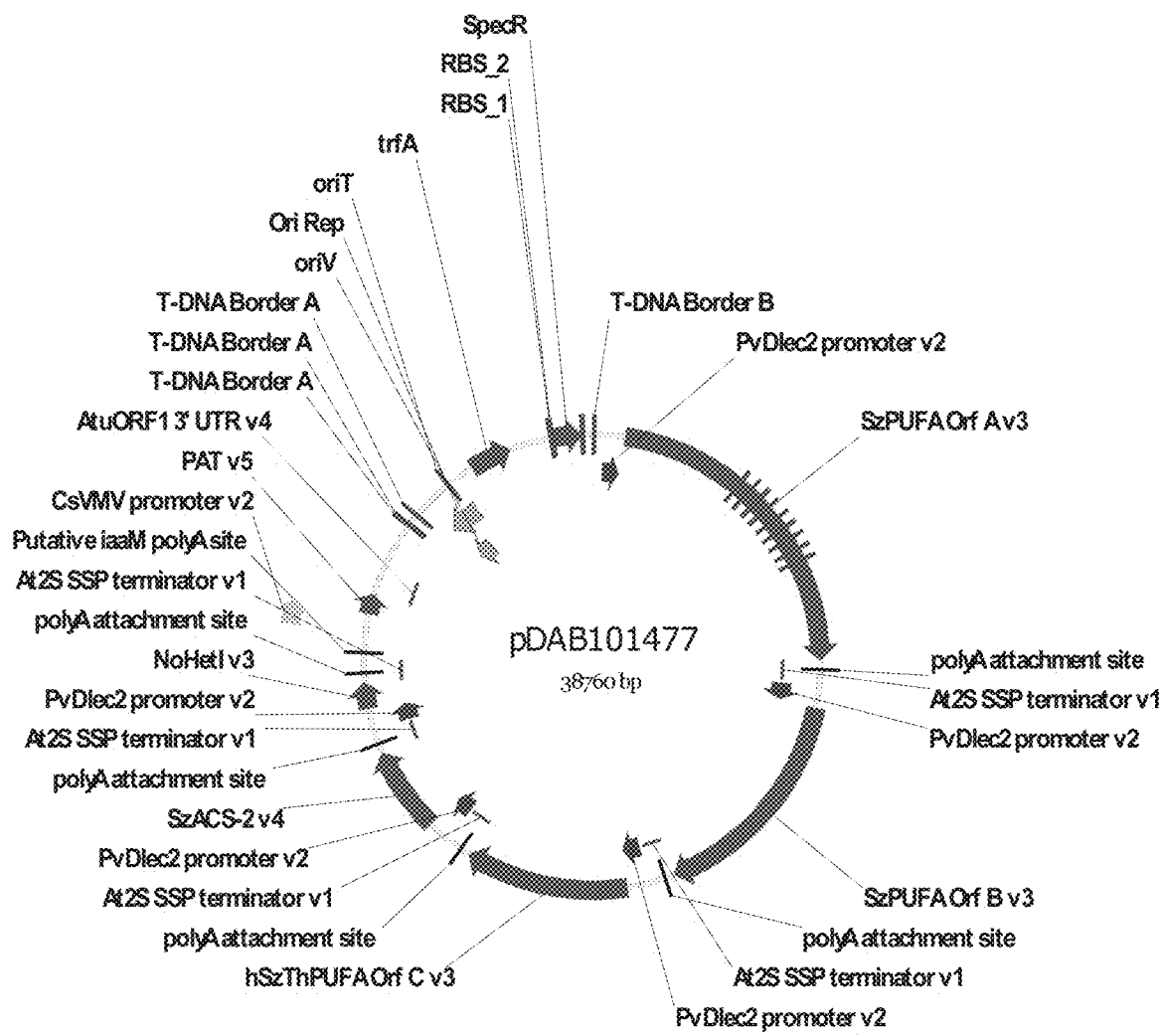
FIG. 11 is a plasmid map of pDAB101477.

Construction of pDAB101477 pDAB101477 is a binary plasmid that was constructed to contain rebuilt, codon optimized versions of SzPUFA OrfA v3, SzPUFA OrfB v3, hSzThPUFA OrfC v3, and NoHetI v3. The pDAB101477 plasmid (FIG. 11; SEQ ID NO:39) was constructed using a multi-site Gateway L-R recombination reaction. pDAB101477 contains three PUFA synthase PTUs, one acyl-CoA synthetase PTU, one phosphopanteth-einyl transferase PTU and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The second PUFA synthase PTU contains the PvDlec2 promoter v2, 2S 5' UTR, SzPUFA OrfB v3 and At2S SSP terminator v1. The third PUFA synthase PTU contains the PvDlec2 promoter v2, 2S 5' UTR, hSzThPUFA OrfC v3 and At2S SSP terminator v1. The acyl-CoA synthetase PTU contains the PvDlec2 promoter v2, 2S 5' UTR, SzACS-2 v4 gene and At2S SSP terminator v1. The phosphopantetheinyl transferase PTU contains the PvDlec2 promoter v2, 2S 5' UTR, NoHetI v3 and At2S SSP terminator v1.

Plasmids pDAB7334, pDAB7335, pDAB7336, pDAB101472 and pDAB7333 were recombined to form pDAB101477. Specifically, the five PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, SzACS-2 v4, NoHetI v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the six PTUs were then isolated and tested for incorporation of the six PTUs with restriction enzyme digestion and DNA sequencing.

Example 3

Soybean Transformation

Transgenic soybean (*Glycine max*) was generated through *Agrobacterium*-mediated transformation of soybean cotyledonary node explants. The disarmed *Agrobacterium* strain DA2552 (U.S. Appl. No. 61/368,965, filed Jul. 29, 2010) carrying the binary vectors described above as pDAB7362 was used to initiate transformation.

*Agrobacterium*-mediated transformation was carried out using a modified ½ cotyledonary node procedure of Zeng et al. (Zeng P., Vadnais D. A., Zhang Z., Polacco J. C., (2004), Plant Cell Rep., 22(7): 478-482). Briefly, soybean seeds (cv. Maverick) were germinated on basal media and cotyledonary nodes were isolated and infected with *Agrobacterium*. Shoot initiation, shoot elongation, and rooting media were supplemented with cefotaxime, timentin and vancomycin for removal of *Agrobacterium*. Glufosinate selection was employed to inhibit the growth of non-transformed shoots. Selected shoots were transferred to rooting medium for root development and then transferred to soil mix for acclimatization of plantlets.

Terminal leaflets of selected plantlets were treated topically (leaf paint technique) with glufosinate to screen for putative transformants. The screened plantlets were transferred to the greenhouse, allowed to acclimate and then leaf-painted with glufosinate to reconfirm tolerance. These putative transformed $T_0$ plants were sampled and molecular analyses was used to confirm the presence of PAT, and the PUFA synthase OrfA, PUFA synthase OrfB, PUFA synthase chimeric OrfC, acyl-CoA synthetase and 4' phosphopantetheinyl transferase HetI transgenes. To plants were allowed to self-fertilize in the greenhouse to produce $T_1$ seed.

A second soybean transformation method was used to produce additional transgenic soybean plants. The disarmed *Agrobacterium* strain DA2552 (U.S. Provisional Patent App. No. 61/368,965) carrying the binary vector described above as pDAB7362 was used to initiate transformation.

*Agrobacterium*-mediated transformation was carried out using a modified half-seed procedure of Paz et al., (M. Paz, J. Martinez, A. Kalvig, T. Fonger, and K. Wang (2005) Plant Cell Rep., 25: 206-213). Briefly, mature soybean seeds were sterilized overnight with chlorine gas, and imbibed with sterile $H_2O$ twenty hours before *Agrobacterium*-mediated plant transformation. Seeds were cut in half by a longitudinal cut along the hilum to separate the seed and remove the seed coat. The embryonic axis was excised and any axial shoots/buds were removed from the cotyledonary node. The resulting half seed explants were infected with *Agrobacterium*. Shoot initiation, shoot elongation, and rooting media were supplemented with cefotaxime, timentin and vancomycin for removal of *Agrobacterium*. Glufosinate selection was employed to inhibit the growth of non-transformed shoots. Selected shoots were transferred to rooting medium for root development and then transferred to soil mix for acclimatization of plantlets.

Terminal leaflets of selected plantlets were treated topically (leaf paint technique) with glufosinate to screen for putative transformants. The screened plantlets were transferred to the greenhouse, allowed to acclimate and then leaf-painted with glufosinate to reconfirm tolerance. These putative transformed $T_0$ plants were sampled and molecular analyses was used to confirm the presence of PAT, and the PUFA synthase OrfA, PUFA synthase OrfB, PUFA synthase chimeric OrfC, acyl-CoA synthetase and 4' phosphopantetheinyl transferase HetI transgenes. Seven events were identified as containing the transgenes from pDAB7362. These $T_0$ plants were advanced for further analysis and allowed to self-fertilize in the greenhouse to give rise to $T_1$ seed.

Example 4

Molecular Analysis of Soybean Events

Transgene copy numbers of selected pDAB7362 soybean events were quantified using a comparative quantitative real time PCR (qPCR) method. Leaf tissue samples were taken from the top and bottom leaves of a mature soybean plant, these samples were combined and the genomic DNA was isolated. Genomic DNA was isolated using the BioSprint 96 DNA Plant Kit and a BioSprint 96 magnetic particle automation platform (Qiagen, Valencia, Calif.) per manufacturer's instructions. Extracted genomic DNA was diluted 1:5 with ddH20 for use as template in quantitative real time PCR reactions (qPCR).

qPCR Assays were designed to detect the SzPUFA OrfA v3, SzPUFA OrfB v3, hThSzPUFA OrfCv3, SzACS-2 v3, NoHetI v3, and PAT v5 transgenes in pDAB7362 soybean plants by using the Roche Assay Design Center (www.universalprobelibrary.com). The primers and probes used in the assays are described in Table 8. The presences of the target genes were detected with fluorescein-amidite (FAM) labeled UPL probes (Roche Diagnostics, Indianapolis, Ind.). These assays were executed in duplex reactions with a soybean internal reference GMFL01-25-J19, GenBank: AK286292.1 (referenced as GMS116 in Table 8), which was labeled with the Cyanine-5 (Cy-5) fluorescent dye.

TABLE 8 qPCR assay primers and probes

| Target | Forward primer | Reverse Primer | Probe |
|---|---|---|---|
| SzPUFA OrfA v3 | SEQ ID NO: 12<br>cacaaccggtgttgatgatg | SEQ ID NO: 13<br>Gagcttcacaaaggctctgc | UPL #18 |
| SzPUFA OrfB v3 | SEQ ID NO: 14<br>gaatccttgcgtcatttggt | SEQ ID NO: 15<br>Caatggactcacgcacaact | UPL #97 |
| hThSzPUFA OrfCv3 | SEQ ID NO: 16<br>ggattacctcaacattgctcct | SEQ ID NO: 17<br>Tgtccatgcgcatatcctt | UPL #26 |
| SzACS2 v3 | SEQ ID NO: 18<br>agaaattgatggctgttggtg | SEQ ID NO: 19<br>Ctgccgtgctgagtttctt | UPL #54 |
| NoHetI v3 | SEQ ID NO: 20<br>ccagaacacagaaggcgttt | SEQ ID NO: 21<br>Tcccaagtatccacccaagat | UPL #3 |
| PAT v5 | SEQ ID NO: 22<br>acaagagtggattgatgatctagagaggt | SEQ ID NO: 23<br>Ctttgatgcctatgtgacacgtaaacagt | SEQ ID NO: 24<br>ccagcgtaagcaataccagccacaacacc |
| GMS116 | SEQ ID NO: 25<br>gtaatatgggctcagaggaatggt | SEQ ID NO: 26<br>atggagaagaacattggaattgc | SEQ ID NO: 27<br>ccatggcccggtaccatctggtc |

Real-time PCR reactions were run on a LC480II real-time PCR thermal cycler (Roche, Indianapolis, Ind.) using standard protocols. Data for the SzPUFA OrfA v3, SzPUFA OrfB v3, hThSzPUFA OrfCv3, SzACS-2 v3, NoHetI v3, and PAT v5, FAM-labeled assays were collected using a 533 nm emission filter and a 483 nm excitation signal. Data for the GMS1.16 Cy5-labeled reference assay was collected using a 660 nm filter and a 618 nm excitation signal. Crossing point values (Cp values) and target to reference ratios were calculated automatically using the LC480II software's "Advanced Relative Quantification" analysis workflow. A target-to-reference ratio for each sample was calculated using the standard "delta-delta-Ct" method. Estimated copy number was determined by normalizing sample target-reference ratios with the target-reference ratio of the soybean internal reference GMFL01-25-J19.

The estimated copy number of the PAT v5 selectable marker and docosahexaenoic acid (DHA) transgenes (SzPUFA OrfA v3, SzPUFA OrfB v3, hThSzPUFA OrfC v3, SzACS-2 v3, and NoHetI v3) was determined in $T_1$ plants from the seven pDAB7362 events. Plants from two events, 7362[710]-71006 and 7362[710]-71010, did not contain either the PAT v5 selectable marker or the DHA gene target sequences. Plants from the remaining events; 7362[710]-70903, 7362[710]-71005, 7362[710]-71008, and 7362[710]-71009, contained the PAT v5 selectable marker and the five DHA transgenes with copy numbers ranging from 1-10. Event 7362[708]-70801 produced T1 plants with 0, 1 or 2 copies of the PAT v5 gene indicating a single segregating locus and event 7362 [710]-71005 produced T1 plants with PAT v5 copy numbers between 0 and 4 suggesting segregation of two unlinked loci.

Example 5

Lipid Analysis of $T_1$ Cotyledons of Transgenic Soybean Plants

To avoid destructive analysis of limited quantities of $T_1$ seeds, fatty acid methyl ester (FAMEs) analysis was performed on post-germination green cotyledons of $T_1$ plants. Methods for the purification and analysis of FAMEs have been described (e.g., Z. D. Nightingale et al. (1999), Purification of fatty acid methyl esters by high-performance liquid chromatography, *J. Chromatogr. B. Biomed. Sci. Appl.* 732(2):495-500; and "Gas chromatography and lipids: a practical guide" by W. W Christie, 1989, The Oily Press). Characterization of the oil profile in the $T_1$ cotyledons is indicative of the oil profile in dry $T_1$ seed (R. F. Wilson and P. Kwanyuen (1986), Triacylglycerol synthesis and metabolism in germinating soybean cotyledons, *Biochimica et Biophysica Acta (BBA)—Lipids and Lipid Metabolism,* 877 (2):231-237).

Example 5.1

Validation of Post-Germination Detection of DHA in $T_1$ Cotyledons Via Analysis of Transgenic Canola Validation and detection of Long Chain Poly Unsaturated Fatty Acids (LC-PUFA) in post-germination green cotyledons was performed with DHA-producing canola seed to assess if characterization of the oil profile in the $T_1$ cotyledons is indicative of the presence of an oil profile within the mature $T_1$ seed. Transgenic canola seed harboring the binary plasmid, pDAB7362, were germinated at room temperature on water-saturated paper towels, and harvested after 3 days at which point the tissue was lyophilized. The tissue was directly transmethylated and not pre-extracted with hexane. The LC-PUFA content (% FAMEs by weight) was calculated and compared to the mature seed. The average DHA content from the 30 canola emerged cotyledons was 0.71% (total LC-PUFA=0.97%) with an oil content of 53.0%. The average DHA content of 48 mature canola seed prior to germination was 0.49% (total LC-PUFA=0.73%) with an oil content of 44.3%. This study demonstrates that LC-PUFAs can be detected post-germination in emerged green cotyledons and that detection of the LC-PUFAs in emerged green cotyledons indicates that LC-PUFA is present in the seed.

Example 5.2

Post-Germination Detection of DHA in $T_1$ Soybean Cotyledons

FAME analysis was performed on one excised green cotyledon per soybean seedling sampled 3 to 5 days after planting. The plant material was lyophilized, homogenized using a steel ball and ball mill and defatted 3 times with hexane. The pooled hexane fraction was evaporated and the dry residue was weighed and reconstituted in heptane. A known amount of oil residue was transmethylated with 0.25 M of freshly prepared sodium methoxide (Sigma-Aldrich, St. Louis, Mo.) in methanol in the presence of the surrogate, triheptadecanoin (Nu-Chek Prep, Elysian, Minn.). The reaction was conducted under mild heat (40° C.) and constant shaking and the resulting FAMEs extracted with heptane. Completion of the reaction was verified by recovery of the reacted heptadecanoate methyl-ester surrogate. The FAMEs extracts were analyzed by GC-FID using an Agilent 6890 Gas Chromatograph (Agilent Technologies, Santa Clara, Calif.) and a 15 m×0.25 mm×0.25 μm BPX 70 capillary column from SGE (Austin, Tex.). Each FAME peak was identified by its retention time and quantified by the injection of a rapeseed oil reference mix from Matreya LLC (Pleasant Gap, Pa.). The calibration standard contained individually added standards of DHA, EPA and DPA(n-6) methyl esters from Nu-Chek. Data analysis was performed using ChemStation4 software (Agilent). $T_1$ cotyledons from two events contained DHA; pDAB7362[708]-70801.001 and pDAB7362[710]-71005.001 (Table 9).

Forty seeds from Event pDAB7362[708]-70801.001 were germinated and screened for the presence of LC-PUFA in excised green cotyledon. Cotyledons from six of the forty seeds contained LC-PUFA in a range of 0.78% to 1.58% (with a mean of 1.12%). DHA content ranged from 0.48% to 0.93% (with a mean of 0.68%), and DP A (n-6) content ranged from 0.3% to 0.65% (with a mean of 0.44%).

Thirty-nine seeds from Event pDAB7362[710]-71005.001 were germinated and screened for the presence of LC-PUFA in excised green cotyledon. Cotyledons from thirty-seven of the thirty-nine seeds contained LC-PUFA in a range of 0.70% to 11.98% (with a mean of 3.91%). Of the total LC-PUFA, DHA content ranged from 0.36% to 8.00% (with a mean of 2.24%), and DPA(n-6) content ranged from 0.34% to 3.98% (with a mean of 1.68%).

Identification of LC-PUFA was confirmed by evaluating specific fragmentation of standard PUFA methyl esters (Nu-Chek Prep, Elysian, Minn.) using a Pegasus III GC-TOF-MS (Leco, St. Joseph, Mich.) compared to a negative control.

house. Plants were selected that contained high levels of LC-PUFAs in the $T_1$ cotyledon and one or two copies of PAT v5 and the accompanying five genes for DHA production. These plants were self-fertilized and the resulting $T_2$ seed harvested at maturity. Single seeds were analyzed via FAMEs GC-FID to determine the LC-PUFA and DHA content in the $T_2$ soybean seed. Twelve whole mature seeds per plant were individually analyzed by crushing the seed with a press and homogenization using a steel ball and ball mill. The tissue was defatted three times with hexane, the pooled hexane fractions were evaporated to dryness and the residue weighed and reconstituted in heptane for FAME analysis performed as described in the previous example.

Figure 12:
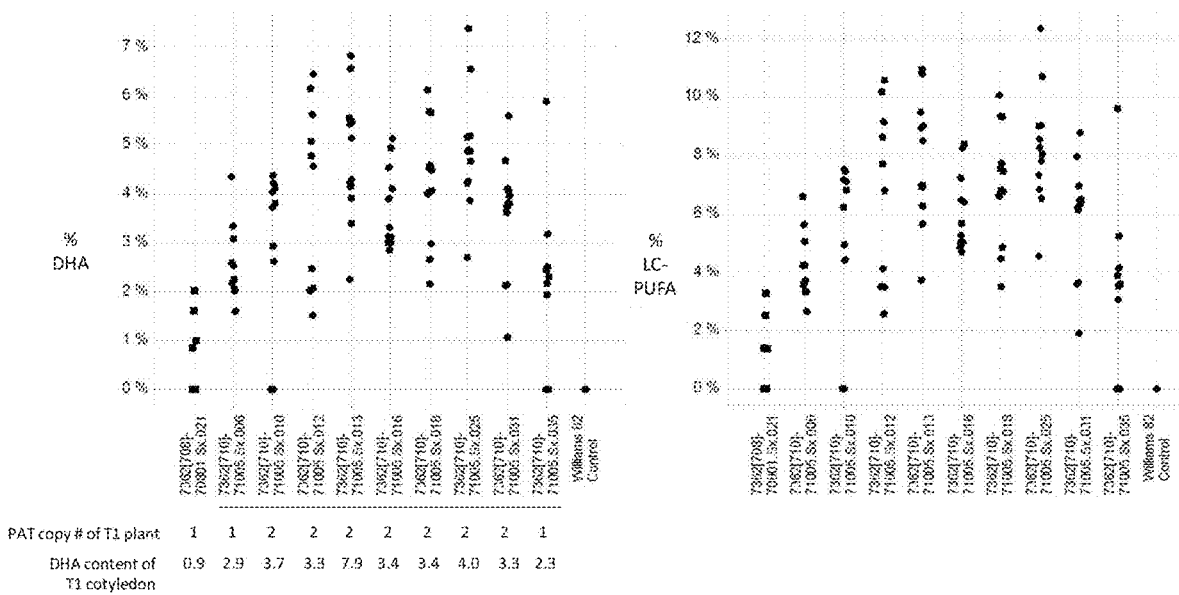
FIG. 12 shows the DHA and LC-PUFA content of single T2 soybean seeds from T1 plants derived from two soybean events transformed with pDAB7362.

Single $T_2$ seeds from a $T_1$ plant of event 7362[708]-70801.001 (described as 7362[708]-70801.Sx.021 in FIG. 12) that possessed a single copy of PAT v5 contained 0% to 0.73% DHA (0% to 1.19% total LC-PUFA). Single $T_2$ seeds from two $T_1$ plants of event 7362[710]-71005.001 (described as 7362[710]-71005.Sx.006 and 7362[710]-71005.Sx.0.35 in FIG. 12) possessing a single copy of PAT v5 contained 0% to 2.08% DHA (0% to 3.56% total LC-PUFA). Single $T_2$ seeds from seven $T_1$ plants of event 7362[710]-71005.001 (described as 7362[710]-71005.Sx.010, 7362[710]-71005.Sx.012, 7362[710]-71005.Sx.013, 7362[710]-71005.Sx.016, 7362[710]-71005.Sx.018, 7362[710]-71005.Sx.025, and 7362[710]-71005 Sx.031 in FIG. 12) containing two copies of PAT v5 contained 0% to 2.84% DHA (0% to 4.77% total LC-PUFA). The mean DHA content of $T_2$ seeds from the highest DHA-producing line (7362[710]-71005.Sx.025) was 1.83% (3.11% total LC-PUFA). The DHA content of each $T_2$ seed from the individual $T_1$ plants is shown in FIG. 12.

DHA comprised 60% of the total LC-PUFA content in those $T_2$ seeds that contained LC-PUFA. Only the two novel LC-PUFAs, DHA and DPA(n-6), were detected in the $T_2$ soybean seeds. The fatty acids that are expected to be found in soybean seeds were detected at normal levels, except that total Cl 8 fatty acids were proportionally lower due to the presence of LC-PUFAs. No other different fatty acids were detected in these transgenic soybean seeds other than DHA and DPA(n-6). The oil content (sum of the masses of the individual FAMEs divided by seed mass) of the transgenic

TABLE 9

LC-PUFA content by weight percentage of total fatty acids from germinated $T_1$ soybean seed cotyledons

| Event ID | # of total seedlings | # of DHA positive seedlings | DHA | | DPA(n-6) | | Total PUFA | |
|---|---|---|---|---|---|---|---|---|
| | | | Mean | Range | Mean | Range | Mean | Range |
| pDAB7362[708]-70801.001 | 40 | 6 | 0.68% | 0.48-0.93% | 0.44% | 0.3-0.65% | 1.12% | 0.78-1.58% |
| pDAB7362[710]-71005.001 | 39 | 37 | 2.24% | 0.36-8.00% | 1.68% | 0.34-3.98% | 3.91% | 0.70-11.98% |
| Williams 82 control | 15 | 0 | 0% | — | 0% | — | 0% | — |

Example 6

Lipid Analysis of Mature $T_2$ Seed from Transgenic Soybean Events $T_1$ plants from two events, 7362[708]-70801.001 and 7362[710]-71005.001, were grown to maturity in the green-seeds and the number of seeds produced by the transgenic $T_1$ lines was not significantly different from that of the non-transgenic Williams 82 control cultivar grown in the greenhouse at the same time under the same conditions.

The complete FAMEs profiles of individual $T_2$ seeds from soybean events 7362[708]-70801.001 and 7362[710]-71005.001 are shown in Table 10.

TABLE 10

FAMEs profiles of individual T$_2$ soybean seeds from two events 7362[708]-70801.001 and 7362[710]-71005.001. Values are percentages of the total FAME content from the 10 to 12 T$_2$ soybean seeds. Total LC-PUFA is the sum of C22:5 (DPA n-6) and C22:6 (DHA) FAME percentage.

| Event Name | C14:0 | C16:0 | C18:0 | C18:1 | C18:2 | C18:3 | C20:0 | C20:1 | C22:0 | C24:0 | C22:5 (DPA n-6) | C22:6 (DHA) | Total LC-PUFA |
|---|---|---|---|---|---|---|---|---|---|---|---|---|---|
| 7362[708]-70801.Sx.021 | 0.16 | 12.99 | 4.98 | 13.84 | 58.09 | 7.88 | 0.36 | 0.16 | 0.22 | 0.11 | 0.46 | 0.73 | 1.19 |
| 7362[710]-71005.Sx.006 | 0.19 | 13.09 | 4.8 | 22.71 | 50.56 | 5.37 | 0.32 | 0.17 | 0.25 | 0.1 | 0.83 | 1.61 | 2.44 |
| 7362[710]-71005.Sx.010 | 0.15 | 12.88 | 5.56 | 16.25 | 55.06 | 6.44 | 0.38 | 0.17 | 0.18 | 0.11 | 1.19 | 1.63 | 2.82 |
| 7362[710]-71005.Sx.012 | 0.18 | 13.41 | 4.15 | 13.67 | 56.63 | 7.09 | 0.35 | 0.16 | 0.21 | 0.11 | 1.58 | 2.46 | 4.04 |
| 7362[710]-71005.Sx.013 | 0.22 | 14.3 | 4.4 | 19.13 | 51.2 | 5.89 | 0.31 | 0.15 | 0.18 | 0.1 | 1.53 | 2.59 | 4.12 |
| 7362[710]-71005.Sx.016 | 0.21 | 14.3 | 4.16 | 15.41 | 55.84 | 6.24 | 0.3 | 0.15 | 0.17 | 0.08 | 1.23 | 1.91 | 3.15 |
| 7362[710]-71005.Sx.018 | 0.17 | 13.88 | 4.65 | 15.3 | 55.14 | 6.26 | 0.35 | 0.16 | 0.19 | 0.08 | 1.5 | 2.32 | 3.82 |
| 7362[710]-71005.Sx.025 | 0.17 | 13.29 | 4.74 | 15.03 | 54.94 | 6.2 | 0.37 | 0.17 | 0.21 | 0.09 | 1.93 | 2.84 | 4.77 |
| 7362[710]-71005.Sx.031 | 0 | 13.42 | 4.5 | 16.4 | 55.73 | 6.13 | 0.19 | 0.1 | 0.24 | 0.06 | 1.27 | 1.96 | 3.23 |
| 7362[710]-71005.Sx.035 | 0.16 | 13.13 | 3.96 | 18.39 | 53.15 | 7.18 | 0.14 | 0.11 | 0.21 | 0 | 1.49 | 2.08 | 3.56 |
| Williams 82 Control | 0.06 | 10.37 | 6.25 | 24.12 | 52.88 | 5.46 | 0.33 | 0.14 | 0.3 | 0.09 | 0 | 0 | 0 |

Example 6.1

Lipid Analysis of Mature T$_3$ Seed from Two Transgenic Soybean Events

Two T$_2$ soybean plant events, 7362[708]-70801.001 and 7362[710]-71005.001, were grown to maturity in the greenhouse. Multiple plants of each event were grown in the greenhouse, and were screened to identify individual plants that produced high levels of LC-PUFAs in the T$_2$ cotyledon and contained a single, homozygous insertion of the transgenes. Identified plants were self-fertilized and the resulting T$_3$ seed was harvested when the seed reached maturity. Single mature T$_3$ seeds were analyzed via FAMEs GC-FID to determine the DHA and LC-PUFA content in the T$_3$ soybean seed (FIG. 12a). Twelve whole mature seeds per plant were individually analyzed by crushing the seed with a press and homogenizing the crushed seed material using a steel ball and ball mill. The tissue was defatted three times with hexane, the pooled hexane fractions were evaporated to dryness and the residue weighed and reconstituted in heptane for FAME analysis performed as described in the previous example. The DHA levels were determined from the T$_3$ seed and compared to the T$_2$ DHA levels, which had been assayed previously (Table 11).

determined to contain from 0% to 0.93% DHA (0% to 1.37% total LC-PUFA). Comparatively, the T$_2$ seeds produced from event 7362[708]-70801.001 were assayed via FAMEs analysis and the seeds were determined to contain from 0% to 0.73% DHA. Single T$_3$ seeds from self-fertilization of a T$_2$ plant event 7362[710]-71005.001-1-35 (this line was molecularly characterized and found to possess a single hemizygous copy of PAT) were assayed via the FAMEs analysis and the seeds were determined to contain 0% to 3.10% DHA (0% to 5.45% total LC-PUFA). Comparatively, the T$_2$ seeds produced from event 7362[710]-71005.001-1-35 were assayed via FAMEs analysis and the seeds were determined to contain from 0% to 2.84% DHA. In addition, Single T$_3$ seeds produced from events 7362[710]-71005.001-1-13, 7362[710]-71005.001-1-18, and 7362[710]-71005.001-1-25 (each event was determined to contain a single, homozygous copy of PAT) contained 0.79% to 4.24% DHA (1.26% to 6.5% total LC-PUFA). Comparatively, the T$_2$ seeds produced from events 7362[710]-71005.001-1-13, 7362[710]-71005.001-1-18, and 7362[710]-71005.001-1-25 were assayed via FAMEs analysis and the seeds were determined to contain from 0.79% to 2.84% DHA. The transgenic events were compared to the control plants, the yield per plant (number of seed) and total

TABLE 11

Average DHA content (%) from randomly chosen mature soybean seed at the T2 and T3 generation from two events 7362[708]70801.001 and 7362[710]-71005.001.

| Event Name | T$_2$ seed | | | | T$_3$ seed | | | |
|---|---|---|---|---|---|---|---|---|
| | n | Mean | Min | Max | n | Mean | Min | Max |
| pDAB7362[708]70801.001-1-21 | 9 | 0.22 | 0 | 0.73 | 90 | 0.27 | 0 | 0.93 |
| pDAB7362[710]71005.001-1-13 | 12 | 1.79 | 0.82 | 2.59 | 45 | 2.11 | 0.79 | 3.91 |
| pDAB7362[710]71005.001-1-18 | 12 | 1.58 | 0.79 | 2.32 | 48 | 2.00 | 1.05 | 3.54 |
| pDAB7362[710]71005.001-1-25 | 12 | 1.83 | 0.99 | 2.84 | 39 | 2.02 | 0.99 | 4.24 |
| pDAB7362[710]71005.001-1-35 | 12 | 0.59 | 0 | 2.08 | 72 | 0.74 | 0 | 3.10 |
| Williams 82 Control | 8 | 0 | 0 | 0 | 15 | 0 | 0 | 0 |

As indicated in Table 11, the relative percentage of DHA in soybean seeds remained constant or increased in subsequent generations of soybean (from the T$_2$ and T$_3$). Single T$_3$ seeds produced from self-fertilization of a T$_2$ plant of event 7362[708]-70801.001 (this line was molecularly characterized and found to possess a single hemizygous copy of PAT) were assayed via the FAMEs analysis and the seeds were oil content (%) was found to be similar to the Williams 82 control in similar conditions as the transgenic lines.

For all lines tested, the percentage of DHA and LC-PUFA that was produced and measured in the soybean seed for the T$_2$ and T$_3$ generations was either consistent or increased in levels from the T$_2$ generation to the T$_3$ generation. These results indicate that the traits are heritable, and that the transmission of the traits to further generations does not result in reduced DHA production.

Example 7

Western Blot Detection of PUFA Synthase Proteins in Transgenic Soybean Seed

PUFA synthase OrfA (encoded by SzPUFA OrfA v3 gene), PUFA synthase OrfB (encoded by SzPUFA OrfB v3 gene) PUFA synthase chimeric OrfC (encoded by hThSzPUFA OrfC v3 gene) and HetI (from *Nostoc* sp. PCC 7120, GenBank ID: P37695, GL20141367) were detected in mature transgenic seed samples by Western blot analysis. Residual soybean $T_2$ seed cake samples were retained after the hexane extraction for FAME analysis. The powdered seed cake was placed in a tube with a single 4.5 mm stainless steel ball and extraction buffer (50 mM Tris, 10 mM EDTA, 2% SDS) was added. The sample tubes were rocked gently for 30 minutes, centrifuged for 15 minutes at 3,000 rcf and the supernatant was used for analysis. The amount of total soluble protein in the seed extract was determined by 660 nm Protein Assay (Thermo Fisher, Rockford, Ill.). Samples were normalized to 1.25 mg/ml total soluble protein and prepared in LDS sample buffer (Invitrogen, Carlsbad, Calif.) with 50 mM DTT for a normalized load of 16.25 µg total soluble protein per lane. Samples were electrophoresed in 3%-8% Tris-acetate gels (Invitrogen, Carlsbad, Calif.) and transferred to nitrocellulose membranes for detection of PUFA synthase OrfA, PUFA synthase OrfB, and PUFA synthase chimeric OrfC. Samples were electroporesed in 4%-12% Bis-Tris gels (Invitrogen, Carlsbad, Calif.) and transferred to nitrocellulose membranes for detection of HetI.

Blots were incubated in blocking buffer then probed with antibodies against the different PUFA synthase OrfA, PUFA synthase OrfB, PUFA synthase chimeric OrfC, and HetI polypeptides. The rabbit anti-A2-A that is directed against the A2 region of *Schizochytrium* PUFA Synthase OrfA (SzPUFS-A), the rabbit anti-B3-A that is directed against the B3 region of *Schizochytrium* PUFA Synthase OrfB (SzPUFS-B), and the rabbit anti-HetI that is directed against the full length HetI polypeptide were used. Region B3 includes the Enoyl Reductase (ER) domain of OrfB. As there is also a homologous ER domain in PUFA synthase chimeric OrfC, this antiserum recognizes both PUFA synthase OrfB and PUFA synthase chimeric OrfC on a western blot. An anti-rabbit fluorescent labeled secondary antibody (Goat Anti-Rabbit AF 633 (Invitrogen, Carlsbad, Calif.)) was used for detection. Blots were visualized on a Typhoon Trio Plus fluorescent imager (GE Healthcare, New Brunswick N.J.).

SDS-PAGE western blots of proteins extracts from mature $T_2$ seed from events 7362[708]-70801 and 7362[710]-71005 showed bands at the appropriate size when probed with PUFA synthase OrfA, PUFA synthase OrfB, PUFA synthase chimeric OrfC, and HetI specific antisera (FIG. 13). The bands for PUFA synthase OrfA, PUFA synthase OrfB, and PUFA synthase chimeric OrfC could also be seen by direct staining with Coomassie Blue.

Example 8

Expression of the Algal PUFA Synthase Gene Suite Using Alternative Promoters

The use of additional transcriptional regulatory elements to express the gene(s) encoding PUFA synthase OrfA, PUFA synthase OrfB, PUFA synthase chimeric OrfC, acyl-CoA synthetase and 4' phosphopantetheinyl transferase HetI proteins can further increase LC-PUFA and DHA content within soybean seeds. Identification and use of transcriptional regulatory elements that express earlier in development during triacylglycerol biosynthesis and deposition, and for extended periods of time can increase the levels of LC-PUFA and DHA within soybean seed by promoting transcription of a LC-PUFA and DHA biosynthetic genes at earlier stages of seed development (e.g., at 15 to 25 DAP) and therefore extend the time of LC-PUFA and DHA production. Examples of such transcriptional regulatory regions include, but are not limited to, the *Lesquerella fendleri* KCS (LfKCS3) promoter (U.S. Pat. No. 7,253,337) and the FAE 1 promoter (U.S. Pat. No. 6,784,342) and the *Brassica oleracea* Acyl Carrier Protein (BoACP) promoter (International Publ. No. WO 1992/18634). In addition, other seed specific promoters such as the phaseolin promoter from *Phaseolus vulgaris* (U.S. Pat. No. 5,504,200) can be used to robustly drive expression of heterologous genes for extended periods of time during seed development to increase the levels of LC-PUFA and DHA within soybean seed. Finally, strong constitutive promoters such as the Cassava Vein Mosaic Virus promoter (CsVMV promoter v2) can be used to drive expression of the heterologous genes throughout all stages of development, thereby increasing the levels of LC-PUFA and DHA within soybean seed and other plant tissues.

These promoters are used singularly or in combination to drive the expression of the PUFA synthase OrfA, PUFA synthase OrfB, PUFA synthase chimeric OrfC, acyl-CoA synthetase and 4' phosphopantetheinyl transferase HetI expression cassettes, which were previously described in plasmid, pDAB7362. Methods to replace transcriptional regulatory regions within a plasmid are well known within the art. As such, a polynucleotide fragment comprising the PvDlec2 promoter v2 is removed from pDAB7362 (or the preceding plasmids used to build pDAB7362) and replaced with new promoter regions. The newly constructed plasmids are used to stably transform soybean plants. Transgenic soybean plants are isolated and molecularly characterized. The resulting LC-PUFA accumulation is determined by analyzing the lipid profiles (FAMEs) using methods described herein, and soybean plants that produce 0.01% to 15% DHA by weight of total fatty acids, 0.01% to 10% DPA(n-6) by weight of total fatty acids, or 0.01% to 10% EPA by weight of total fatty acids are identified.

Use of Promoters that Express Early in Seed Development

Example 8.1

Construction of pDAB9166

Figure 14:
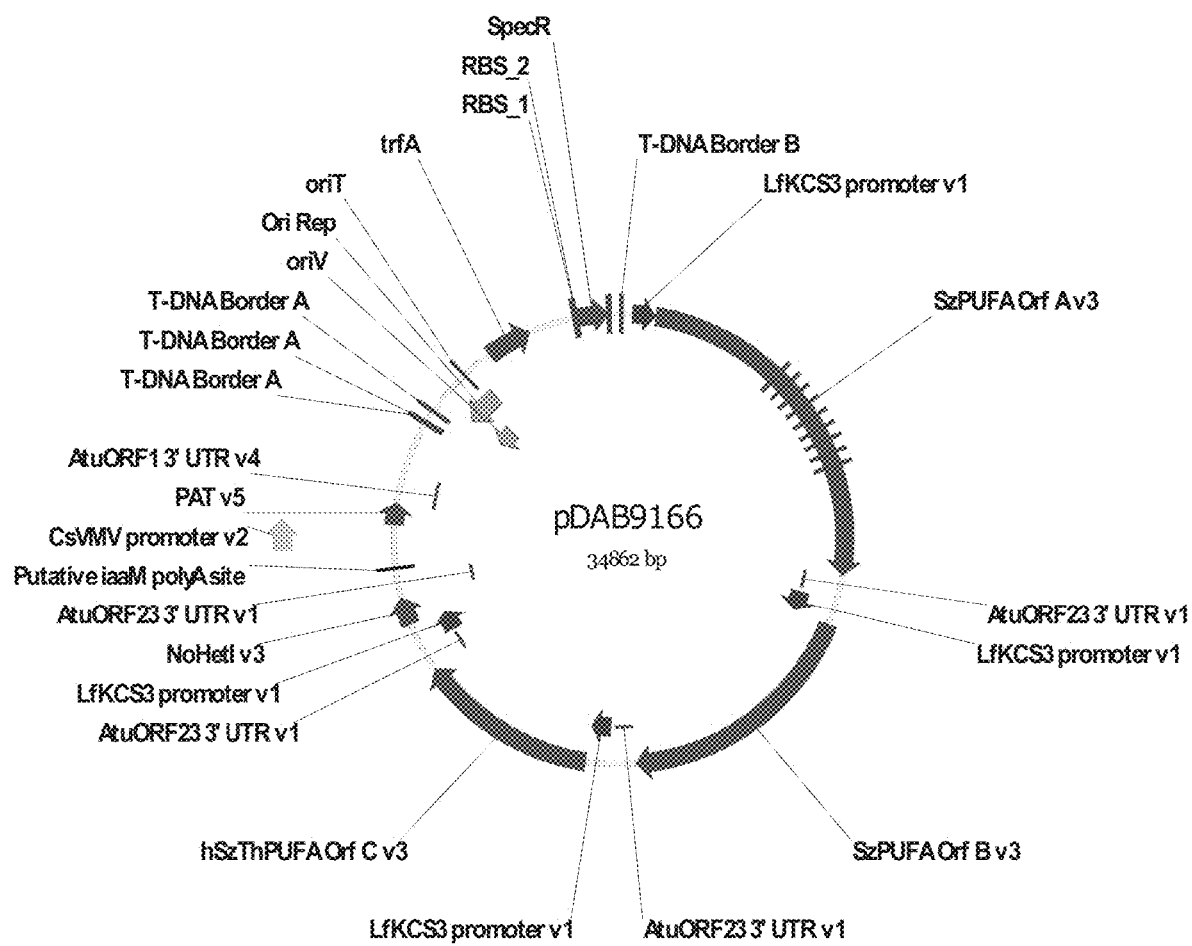
FIG. 14 is a plasmid map of pDAB9166.

The pDAB9166 plasmid (FIG. 14; SEQ ID NO:40) was constructed using a multi-site Gateway L-R recombination reaction. pDAB9166 contains three PUFA synthase PTUs, one phosphopantetheinyl transferase PTU and a phosphinothricin acetyl transferase PTU. Specifically, the first PUFA synthase PTU contains the LfKCS3 promoter v1, SzPUFA OrfA v3 and AtuORF23 3' UTR v1. The second PUFA synthase PTU contains the LfKCS3 promoter v1, SzPUFA OrfB v3 and AtuOrf23 3' UTR v1. The third PUFA synthase PTU contains the Lf CS3 promoter v1, hSzThPUFA OrfC v3 and AtuORF23 3' UTR v1. The phosphopantetheinyl transferase PTU contains the LfKCS3 promoter v1, NoHetI v3 and AtuORF23 3' UTR v1.

Plasmids pDAB9161, pDAB9162, pDAB9163, pDAB101484 and pDAB7333 were recombined to form pDAB9166. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the five PTUs with restriction enzyme digestion and DNA sequencing.

Example 8.2

Construction of pDAB9167

Figure 15:
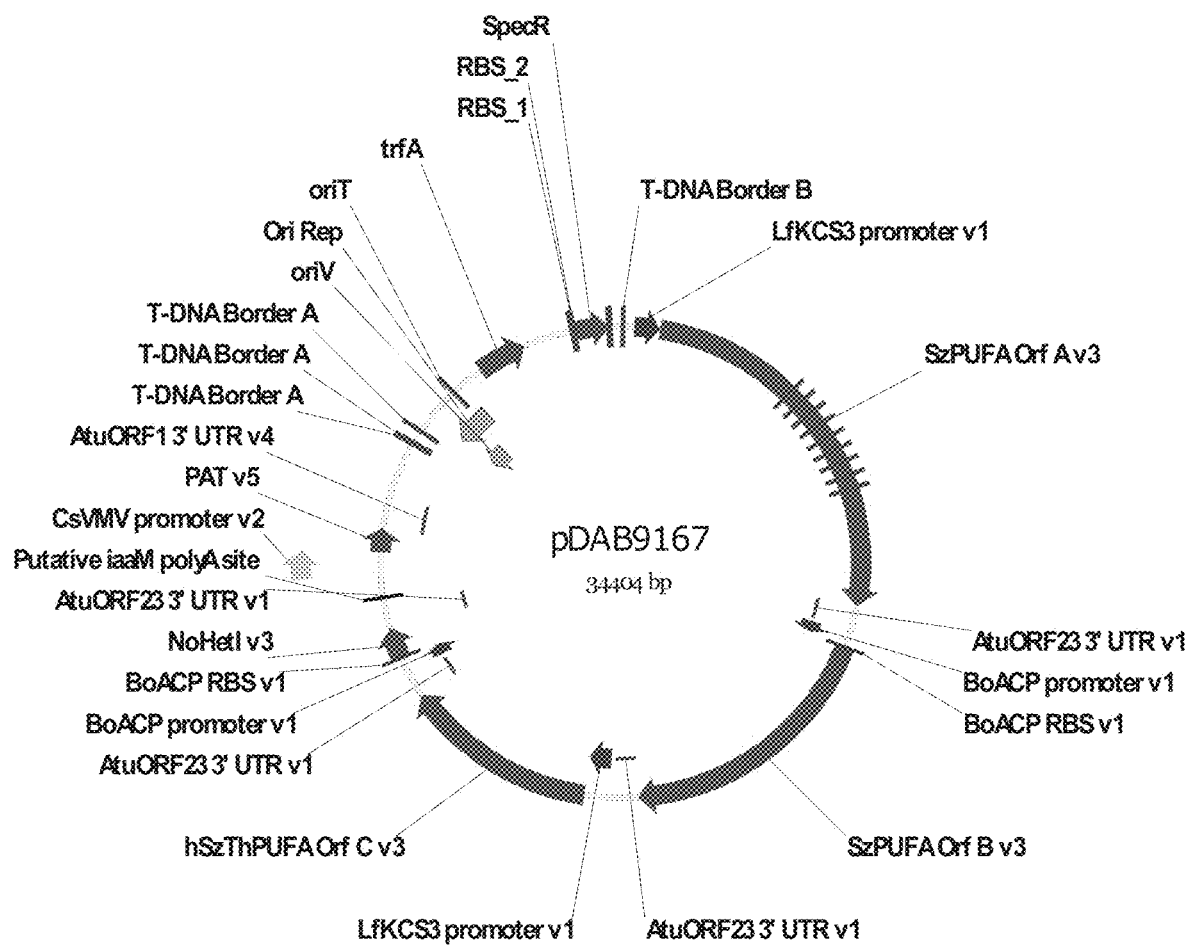
FIG. 15 is a plasmid map of pDAB9167.

The pDAB9167 plasmid (FIG. 15; SEQ ID NO:41) was constructed using a multi-site Gateway L-R recombination reaction. pDAB9167 contains three PUFA synthase PTUs, one phosphopantetheinyl transferase PTU and a phosphinothricin acetyl transferase PTU. Specifically, the first PUFA synthase PTU contains the LfKCS3 promoter v1, SzPUFA OrfA v3 and AtuORF23 3' UTR v1. The second PUFA synthase PTU contains the BoACP promoter v1, BoACP 5' UTR v1, SzPUFA OrfB v3 and AtuOrf23 3' UTR v1. The third PUFA synthase PTU contains the LfKCS3 promoter v1, hSzThPUFA OrfC v3 and AtuORF23 3' UTR v1. The phosphopantetheinyl transferase PTU contains the BoACP promoter v1, BoACP 5' UTR v1, NoHetI v3 and AtuORF23 3' UTR v1.

Plasmids pDAB9161, pDAB9165, pDAB9163, pDAB101485 and pDAB7333 were recombined to form pDAB9167. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the five PTUs with restriction enzyme digestion and DNA sequencing.

Plasmids Containing the Phaseolin Promoter

Example 8.3

Figure 16:
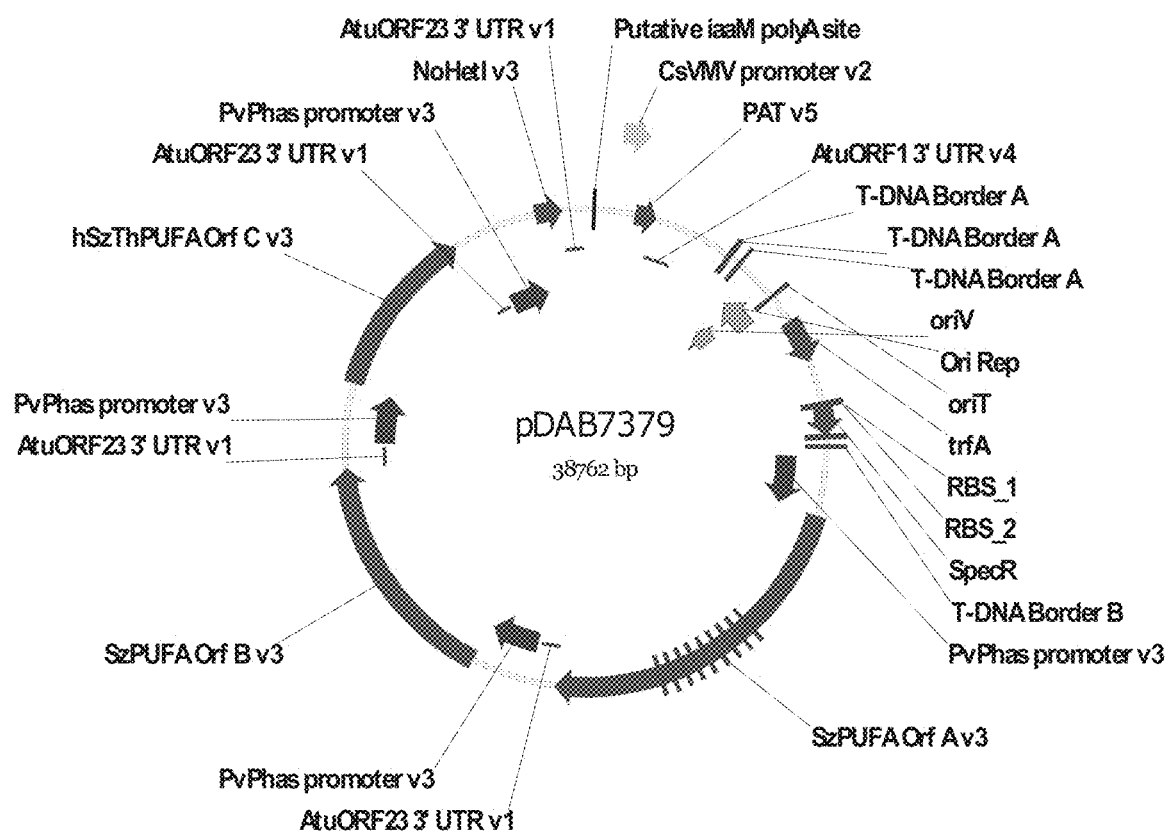
FIG. 16 is a plasmid map of pDAB7379.

Construction of pDAB7379 pDAB7379 is a binary plasmid that was constructed to contain rebuilt, codon optimized versions of SzPUFA OrfA, SzPUFA OrfB, hSzThPUFA OrfC, and NoHetI. The SzACS-2 gene sequence is not included in this construct. The pDAB7379 plasmid (FIG. 16; SEQ ID NO:42) was constructed using a multi-site Gateway L-R recombination reaction.

pDAB7379 contains three PUFA synthase PTUs, one phosphopantetheinyl transferase PTU and a phosphinothricin acetyl transferase PTU. Specifically, the first PUFA synthase PTU contains the PvPhas Promoter v3, PvPhas 5' UTR, SzPUFA OrfA v3 and AtuORF23 3' UTR v1. The second PUFA synthase PTU contains the PvPhas Promoter v3, PvPhas 5' UTR, SzPUFA OrfB v3 and AtuORF23 3' UTR v1. The third PUFA synthase PTU contains the PvPhas Promoter v3, PvPhas 5' UTR, hSzThPUFA OrfC v3 and AtuORF23 3' UTR v1. The phosphopantetheinyl transferase PTU contains the PvPhas Promoter v3, PvPhas 5' UTR, NoHetI v3 and AtuORF23 3' UTR v1.

Plasmids pDAB7371, pDAB7372, pDAB7373, pDAB7374 and pDAB7333 were recombined to form pDAB7379. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the five PTUs with restriction enzyme digestion and DNA sequencing.

Example 8.4

Figure 17:
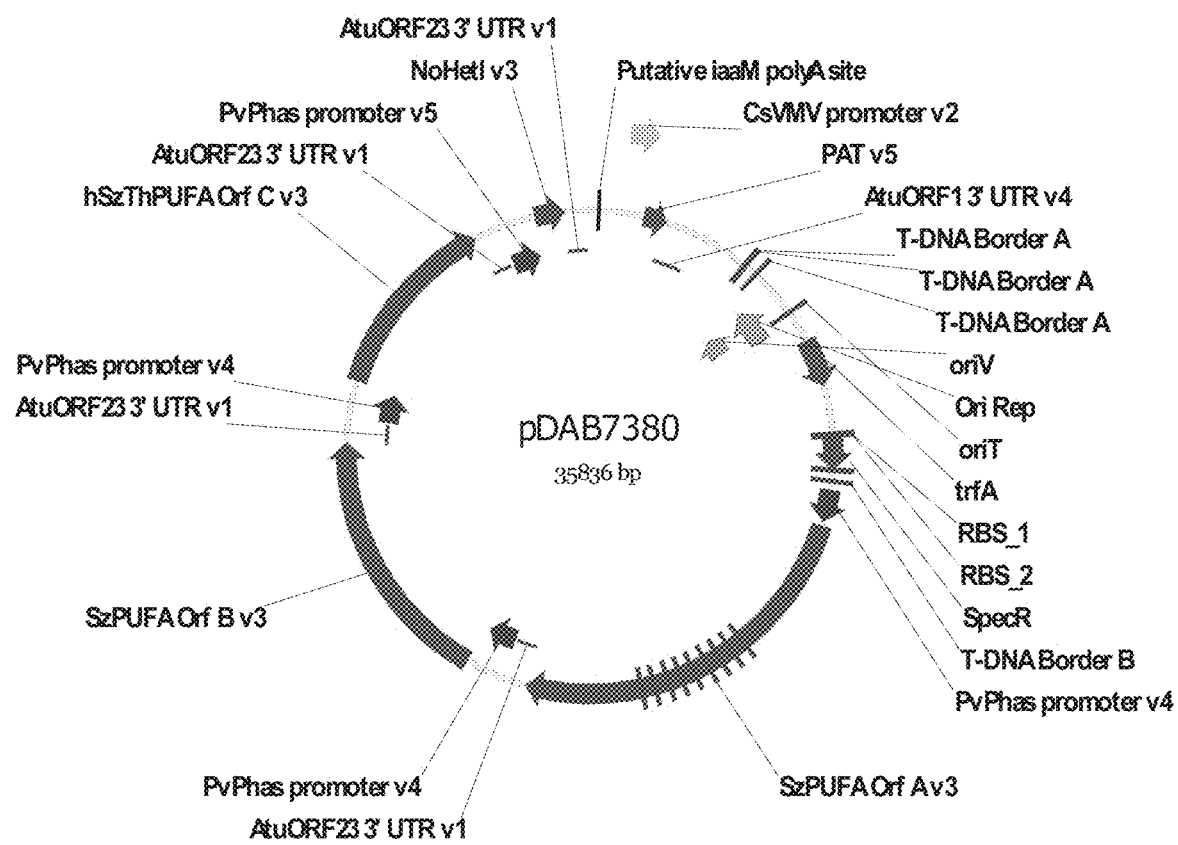
FIG. 17 is a plasmid map of pDAB7380.

Construction of DAB7380 pDAB7380 is a binary plasmid that was constructed to contain rebuilt, codon optimized versions of SzPUFA OrfA, SzPUFA OrfB, hSzThPUFA OrfC, and NoHetI. The SzACS-2 gene sequence is not contained in this construct. The version of the phaseolin promoter used in this construct was modified essentially as described in Bustos et al., 1989 (The Plant Cell, Vol. 1; 839-853), wherein the 5' portion of the promoter was truncated and the phaseolin 5' untranslated region was left intact. The pDAB7380 plasmid (FIG. 17; SEQ ID NO:43) was constructed using a multi-site Gateway L-R recombination reaction.

pDAB7380 contains three PUFA synthase PTUs, one phosphopantetheinyl transferase PTU and a phosphinothricin acetyl transferase PTU. Specifically, the first PUFA synthase PTU contains the PvPhas Promoter v4, PvPhas 5' UTR, SzPUFA OrfA v3 and AtuORF23 3' UTR v1. The second PUFA synthase PTU contains the PvPhas Promoter v4, PvPhas 5' UTR, SzPUFA OrfB v3 and AtuORF23 3' UTR v1. The third PUFA synthase PTU contains the PvPhas Promoter v4, PvPhas 5' UTR, hSzThPUFA OrfC v3 and AtuORF23 3' UTR v1. The phosphopantetheinyl transferase PTU contains the PvPhas Promoter v5, PvPhas 5' UTR, NoHetI v3 and AtuORF23 3' UTR v1.

Plasmids pDAB7375, pDAB7376, pDAB7377, pDAB7378 and pDAB7333 were recombined to form pDAB7380. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the five PTUs with restriction enzyme digestion and DNA sequencing.

Example 8.5

Figure 18:
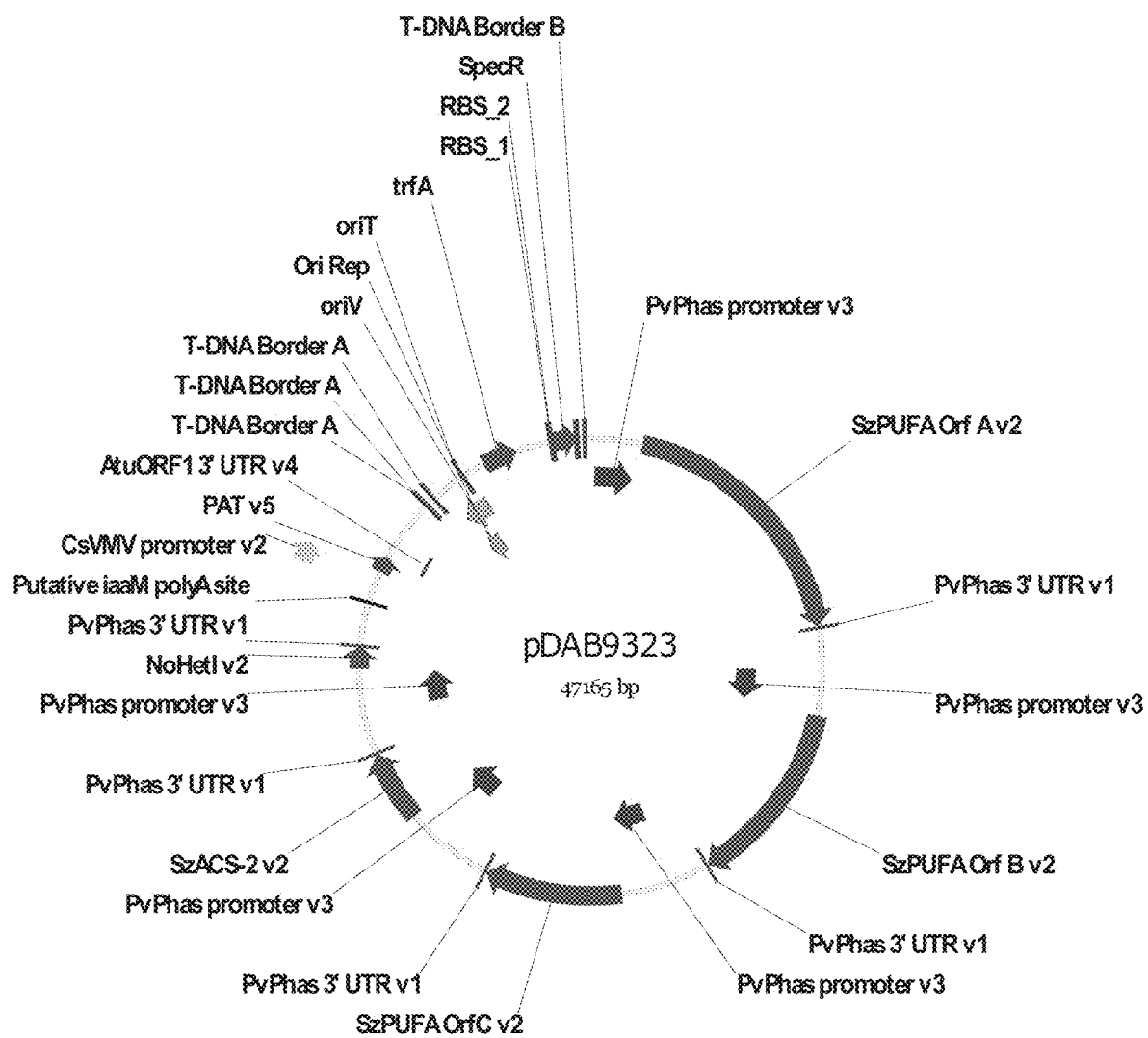
FIG. 18 is a plasmid map of pDAB9323.

Construction of DAB9323 pDAB9323 is a binary plasmid that was constructed to contain native, non-codon optimized versions of SzPUFA OrfA, SzPUFA OrfB, hSzThPUFA OrfC, SzACS-2, and NoHetI. The pDAB9323 plasmid (FIG. 18; SEQ ID NO:44) was constructed using a multi-site Gateway L-R recombination reaction.

pDAB9323 contains three PUFA synthase PTUs, one acyl-CoA synthetase PTU, one phosphopantetheinyl transferase PTU and a phosphinothricin acetyl transferase PTU. Specifically, the first PUFA synthase PTU contains the PvPhas Promoter v3, PvPhas 5' UTR, SzPUFA OrfA v2, PvPhas 3' UTR v1 and PvPhas 3' MAR v2 (unannotated on the plasmid map). The second PUFA synthase PTU contains the PvPhas Promoter v3, PvPhas 5' UTR, SzPUFA OrfB v2, PvPhas 3' UTR v1 and PvPhas 3' MAR v2 (unannotated on the plasmid map). The third PUFA synthase PTU contains the PvPhas Promoter v3, PvPhas 5' UTR, SzPUFA OrfC v2, PvPhas 3' UTR v1 and PvPhas 3' MAR v2 (unannotated on the plasmid map). The acyl-CoA synthetase PTU contains the PvPhas Promoter v3, PvPhas 5' UTR, SzACS-2 v2 gene, PvPhas 3' UTR v1 and PvPhas 3' MAR v2 (unannotated on the plasmid map). The phosphopantetheinyl transferase PTU contains the PvPhas Promoter v3, PvPhas 5' UTR, NoHetI v2, PvPhas 3' UTR v1 and PvPhas 3' MAR v2 (unannotated on the plasmid map).

Plasmids pDAB9307, pDAB9311, pDAB9315, pDAB9322 and pDAB7333 were recombined to form pDAB9323. Specifically, the five PTUs described above were placed in a head-to-tail orientation within the T-strand DNA border regions of the plant transformation binary pDAB7333. The order of the genes is: SzPUFA OrfA v2, SzPUFA OrfB v2, SzPUFA OrfC v2, NoHetI v2. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the six PTUs were then isolated and tested for incorporation of the six PTUs with restriction enzyme digestion and DNA sequencing.

Example 8.6

Figure 19:
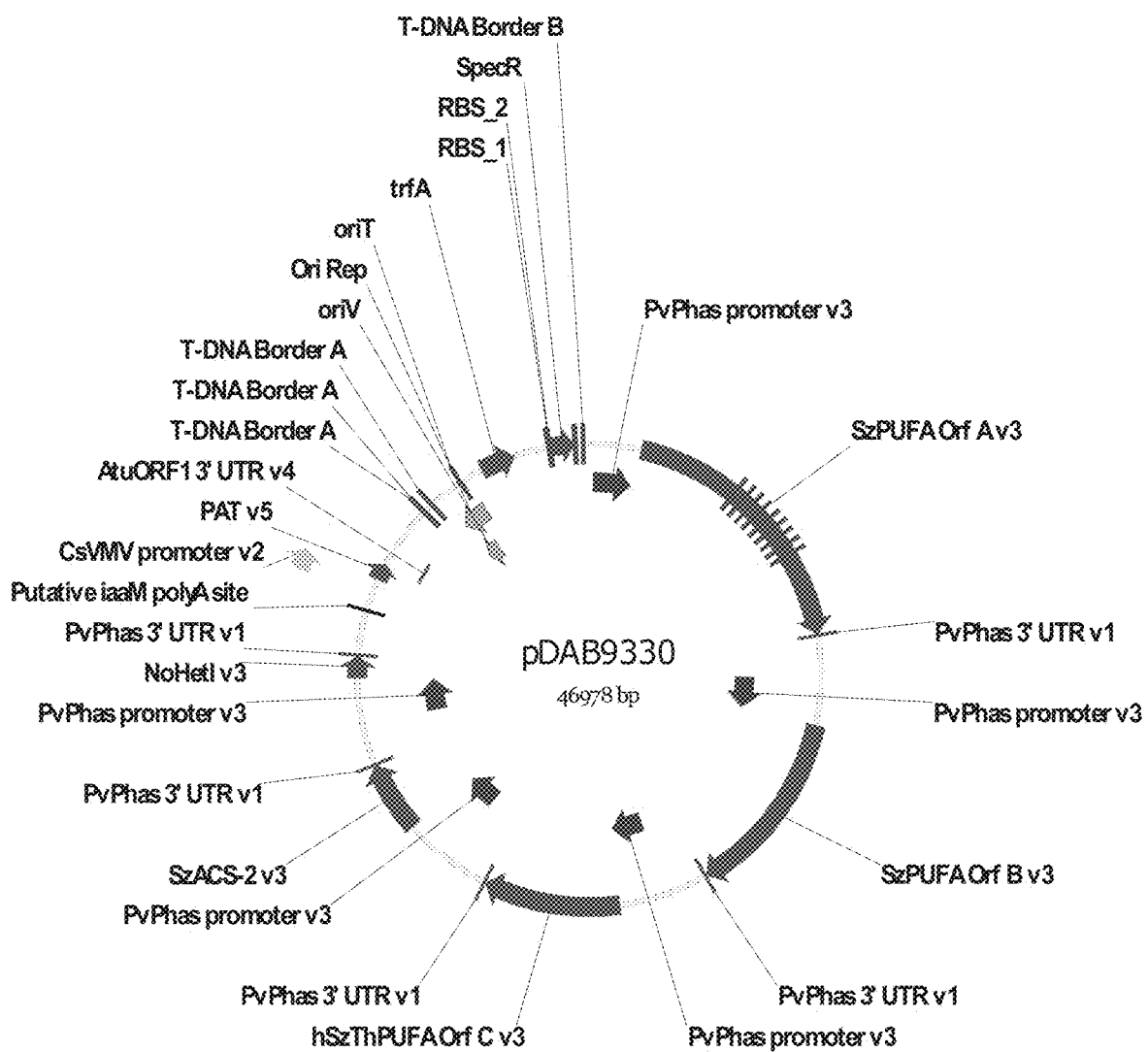
FIG. 19 is a plasmid map of pDAB9330.

Construction of pDAB9330 pDAB9330 is a binary plasmid that was constructed to contain rebuilt, codon optimized versions of SzPUFA OrfA, SzPUFA OrfB, hSzThPUFA OrfC, SzACS-2, and NoHetI. The pDAB9330 plasmid (FIG. 19; SEQ ID NO:45) was constructed using a multi-site Gateway L-R recombination reaction. pDAB9330 contains three PUFA synthase PTUs, one acyl-CoA synthetase PTU, one phosphopantetheinyl transferase PTU and a phosphinothricin acetyl transferase PTU. Specifically, the first PUFA synthase PTU contains the PvPhas Promoter v3, PvPhas 5' UTR, SzPUFA OrfA v3, PvPhas 3' UTR v1 and PvPhas 3' MAR v2 (unannotated on the plasmid map). The second PUFA synthase PTU contains the PvPhas Promoter v3, PvPhas 5' UTR, SzPUFA OrfB v3, PvPhas 3' UTR and PvPhas 3' MAR v2 (unannotated on the plasmid map). The third PUFA synthase PTU contains the PvPhas Promoter v3, PvPhas 5' UTR, hSzThPUFA OrfC v3, PvPhas 3' UTR v1 and PvPhas 3' MAR v2 (unannotated on the plasmid map). The acyl-CoA synthetase PTU contains the PvPhas Promoter v3, PvPhas 5' UTR, SzACS-2 v3 gene, PvPhas 3' UTR v1 and PvPhas 3' MAR v2 (unannotated on the plasmid map). The phosphopantetheinyl transferase PTU contains the PvPhas Promoter v3, PvPhas 5' UTR, NoHetI v3, PvPhas 3' UTR v1 and PvPhas 3' MAR v2 (unannotated on the plasmid map).

Plasmids pDAB9324, pDAB9325, pDAB9326, pDAB9329 and pDAB7333 were recombined to form pDAB9330. Specifically, the five PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, SzACS-2 v3, NoHetI v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the six PTUs were then isolated and tested for incorporation of the six PTUs with restriction enzyme digestion and DNA sequencing.

Example 8.7

Figure 20:
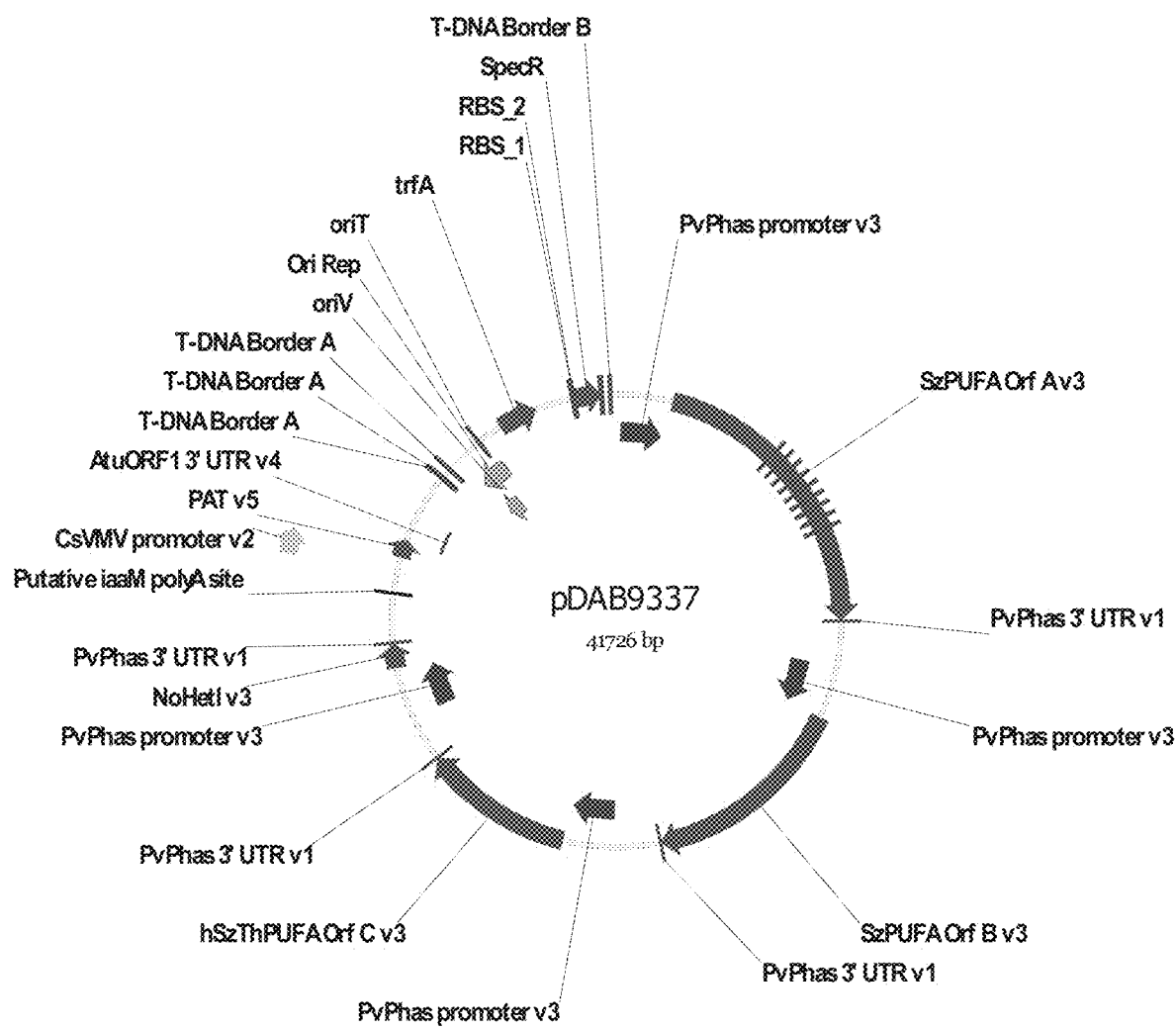
FIG. 20 is a plasmid map of pDAB9337.

Construction of pDAB9337 pDAB9337 is a binary plasmid that was constructed to contain rebuilt, codon optimized versions of SzPUFA OrfA, SzPUFA OrfB, hSzThPUFA OrfC, and NoHetI expression of which is driven by the phaseolin promoter. The pDAB9337 plasmid (FIG. 20; SEQ ID NO:46) was constructed using a multi-site Gateway L-R recombination reaction.

pDAB9337 contains three PUFA synthase PTUs, one phosphopantetheinyl transferase PTU and a phosphinothricin acetyl transferase PTU. Specifically, the first PUFA synthase PTU contains the PvPhas Promoter v3, PvPhas 5' UTR, SzPUFA OrfA v3, PvPhas 3' UTR v1 and PvPhas 3' MAR v2 (unannotated on the plasmid map). The second PUFA synthase PTU contains the PvPhas Promoter v3, PvPhas 5' UTR, SzPUFA OrfB v3, PvPhas 3' UTR v1 and PvPhas 3' MAR v2 (unannotated on the plasmid map). The third PUFA synthase PTU contains the PvPhas Promoter v3, PvPhas 5' UTR, hSzThPUFA OrfC v3, PvPhas 3' UTR v1 and PvPhas 3' MAR v2 (unannotated on the plasmid map). The phosphopantetheinyl transferase PTU contains the PvPhas Promoter v3, PvPhas 5' UTR, NoHetI v3, PvPhas 3' UTR v1 and PvPhas 3' MAR v2 (unannotated on the plasmid map).

Plasmids pDAB9324, pDAB9325, pDAB9326, pDAB9328 and pDAB7333 were recombined to form pDAB9337. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the five PTUs with restriction enzyme digestion and DNA sequencing.

Example 8.8

Figure 21:
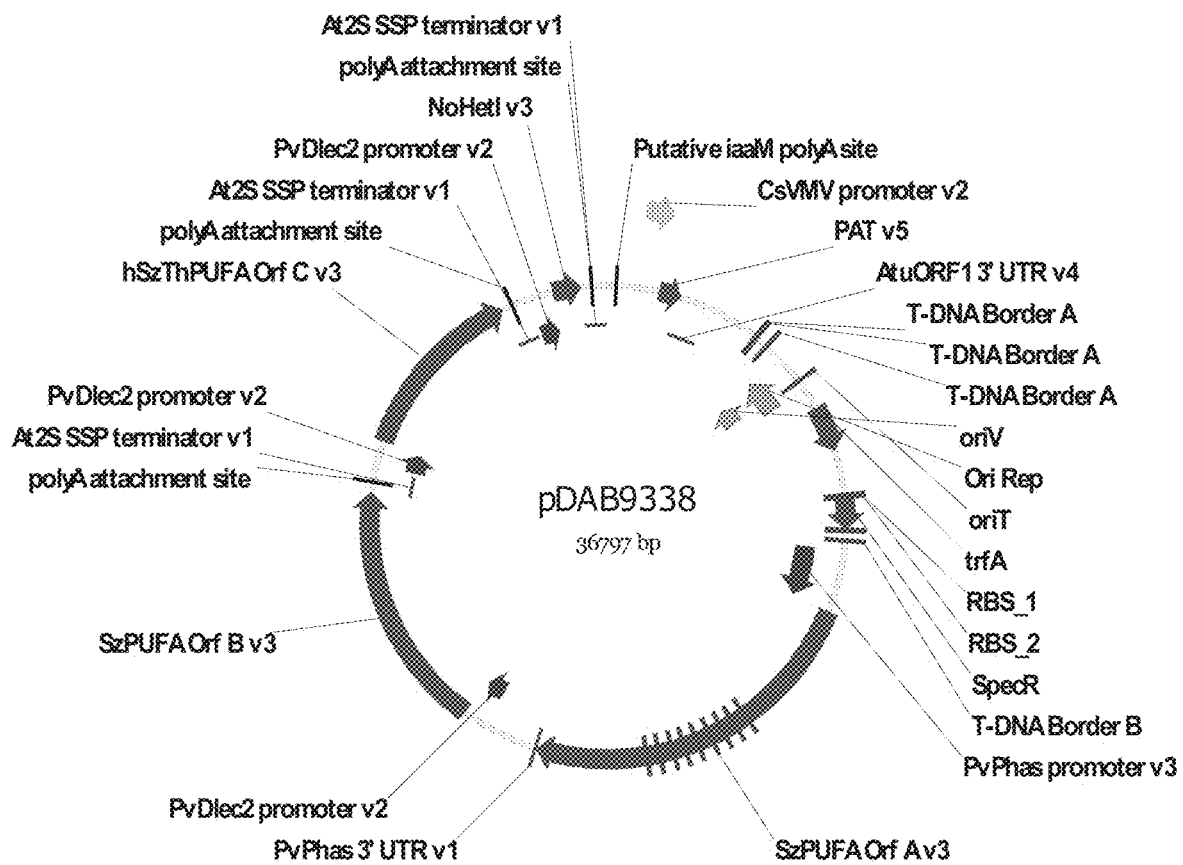
FIG. 21 is a plasmid map of pDAB9338.

Construction of pDAB9338 pDAB9338 is a binary plasmid that was constructed to contain rebuilt, codon optimized versions of SzPUFA OrfA, SzPUFA OrfB, hSzThPUFA OrfC, and NoHetI. The phaseolin promoter is used to drive expression of SzPUFA OrfA, and PvDlec2 promoter is used to drive the other transgenes. The pDAB9338 plasmid (FIG. 21; SEQ ID NO:47) was constructed using a multi-site Gateway L-R recombination reaction.

pDAB9338 contains three PUFA synthase PTUs, one phosphopantetheinyl transferase PTU and a phosphinothricin acetyl transferase PTU. Specifically, the first PUFA synthase PTU contains the PvPhas Promoter v3, PvPhas 5' UTR, SzPUFA OrfA v3, PvPhas 3' UTR v1 and PvPhas 3' MAR v2 (unannotated on the plasmid map). The second PUFA synthase PTU contains the PvDlec2 promoter v2, 2S 5' UTR, SzPUFA OrfB v3 and At2S SSP terminator v1. The third PUFA synthase PTU contains the PvDlec2 promoter v2, 2S 5' UTR, hSzThPUFA OrfC v3 and At2S SSP terminator v1. The phosphopantetheinyl transferase PTU contains the PvDlec2 promoter v2, 2S 5' UTR, NoHetI v3 and At2S SSP terminator v1.

Plasmids pDAB9324, pDAB7335, pDAB7336, pDAB7338 and pDAB7333 were recombined to form pDAB9338. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the five PTUs with restriction enzyme digestion and DNA sequencing.

Example 8.9

Construction of pDAB9344 pDAB9344 is a binary plasmid that was constructed to contain rebuilt, codon optimized versions of SzPUFA OrfA, SzPUFA OrfB, hSzThPUFA OrfC, and NoHetI all of which contain the Ribulose Bisphosphate Carboxylase small chain 1A (labeled as SSU-TP v1), which is fused to the amino terminus of the coding sequence. The phaseolin promoter is used to drive expression of SzPUFA OrfA, and PvDlec2 promoter is used to drive the other transgenes.

Figure 22:
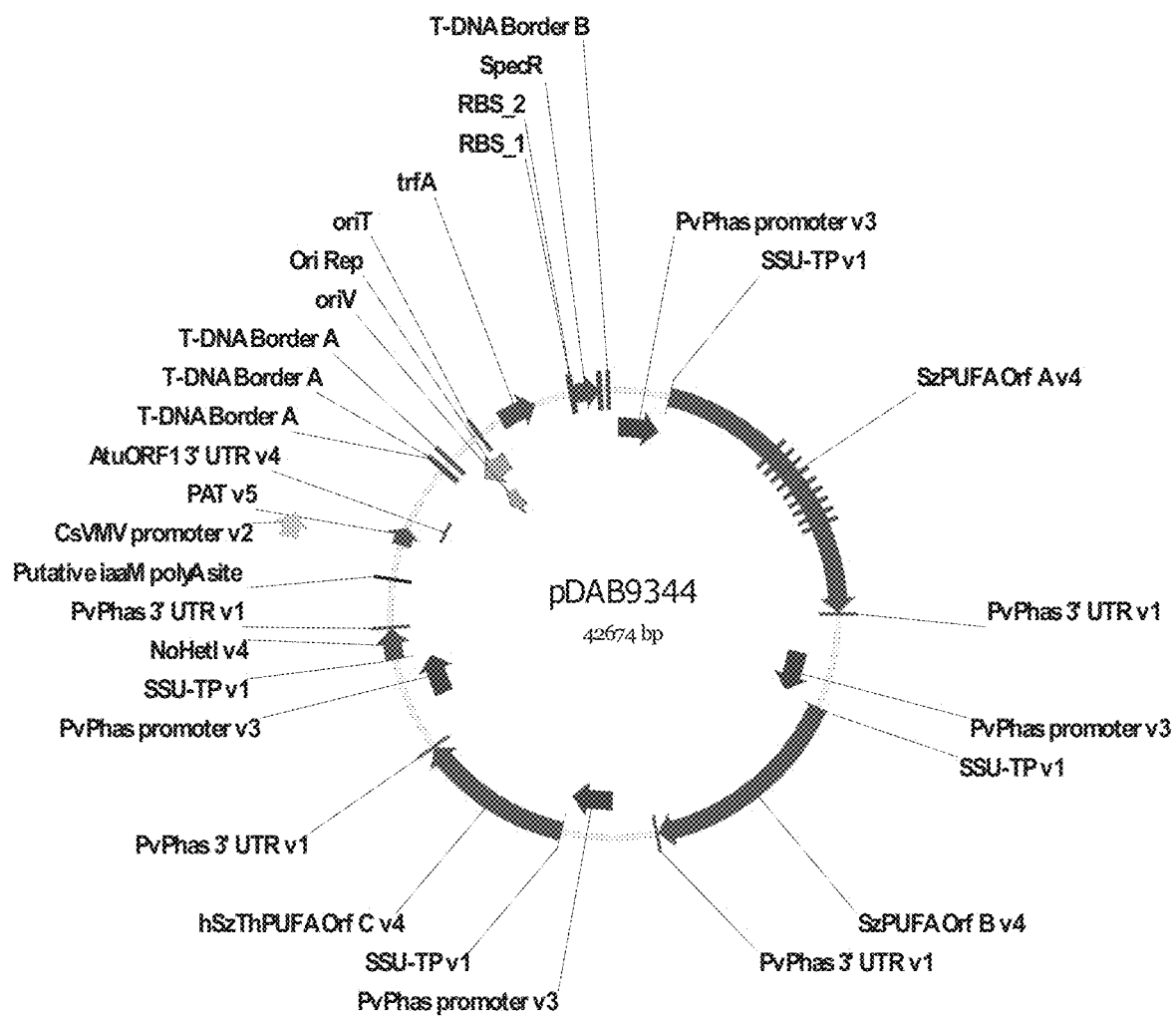
FIG. 22 is a plasmid map of pDAB9344.

The pDAB9344 plasmid (FIG. 22; SEQ ID NO:48) was constructed using a multi-site Gateway L-R recombination reaction. pDAB9344 contains three PUFA synthase PTUs, one phosphopantetheinyl transferase PTU and a phosphinothricin acetyl transferase PTU. Specifically, the first PUFA synthase PTU contains the PvPhas Promoter v3, PvPhas 5' UTR, SzPUFA OrfA v4, PvPhas 3' UTR v1 and PvPhas 3' MAR v2 (unannotated on the plasmid map). The second PUFA synthase PTU contains the PvPhas Promoter v3, PvPhas 5' UTR, SzPUFA OrfB v4, PvPhas 3' UTR v1 and PvPhas 3' MAR v2 (unannotated on the plasmid map). The third PUFA synthase PTU contains the PvPhas Promoter v3, PvPhas 5' UTR, hSzThPUFA OrfC v4, PvPhas 3' UTR v1 and PvPhas 3' MAR v2 (unannotated on the plasmid map). The phosphopantetheinyl transferase PTU contains the PvPhas Promoter v3, PvPhas 5' UTR, NoHetI v4, PvPhas 3' UTR v1 and PvPhas 3' MAR v2 (unannotated on the plasmid map).

Plasmids pDAB9343, pDAB9342, pDAB9340, pDAB9331 and pDAB7333 were recombined to form pDAB9344. Specifically, the four PTUs described above were placed in a head-to-tail orientation within the T-strand DNA border regions of the plant transformation binary pDAB7333. The order of the genes is: SzPUFA OrfA v4, SzPUFA OrfB v4, hSzThPUFA OrfC v4, NoHetI v4. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the six PTUs were then isolated and tested for incorporation of the five PTUs with restriction enzyme digestion and DNA sequencing.

Example 8.10

Construction of DAB9396 pDAB9396 is a binary plasmid that was constructed to contain rebuilt, codon optimized versions of SzPUFA OrfA, SzPUFA OrfB, hSzThPUFA OrfC, SzACS-2, and NoHetI. The phaseolin promoter is used to drive expression of SzPUFA OrfA and SzPUFA OrfB. The PvDlec2 promoter is used to drive the other transgenes; hSzThPUFA OrfC, SzACS-2, and NoHetI.

Figure 23:
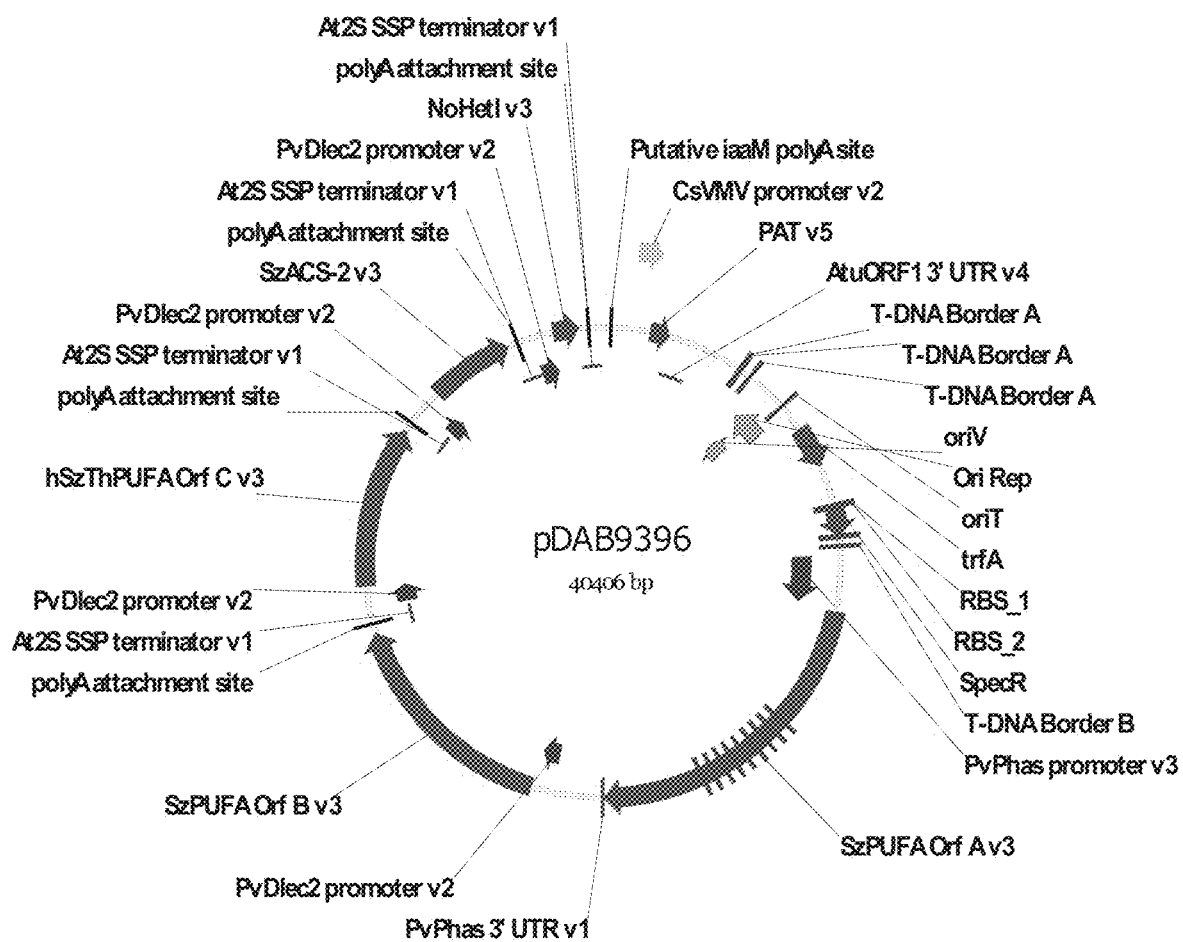
FIG. 23 is a plasmid map of pDAB9396.

The pDAB9396 plasmid (FIG. 23; SEQ ID NO:49) was constructed using a multi-site Gateway L-R recombination reaction. pDAB9396 contains three PUFA synthase PTUs, one phosphopantetheinyl transferase PTU and a phosphinothricin acetyl transferase PTU. Specifically, the first PUFA synthase PTU contains the PvPhas Promoter v3, PvPhas 5' UTR, SzPUFA OrfA v3, PvPhas 3' UTR v1 and PvPhas 3' MAR v2 (unannotated on the plasmid map). The second PUFA synthase PTU contains the PvDlec2 promoter v2, 2S 5' UTR, SzPUFA OrfB v3 and At2S SSP terminator v1. The third PUFA synthase PTU contains the PvDlec2 promoter v2, 2S 5' UTR, hSzThPUFA OrfC v3 and At2S SSP terminator v1. The acyl-CoA synthetase PTU contains the PvPhas Promoter v3, PvPhas 5' UTR, SzACS-2 v3 gene, PvPhas 3' UTR v1 and PvPhas 3' MAR v2 (unannotated on the plasmid map). The phosphopantetheinyl transferase PTU contains the PvDlec2 promoter v2, 2S 5' UTR, NoHetI v3 and At2S SSP terminator v1.

Plasmids pDAB9324, pDAB7335, pDAB7336, pDAB7339 and pDAB7333 were recombined to form pDAB9338. Specifically, the five PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, SzACS-2 v3, NoHetI v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the six PTUs with restriction enzyme digestion and DNA sequencing.

Example 8.11

Figure 24:
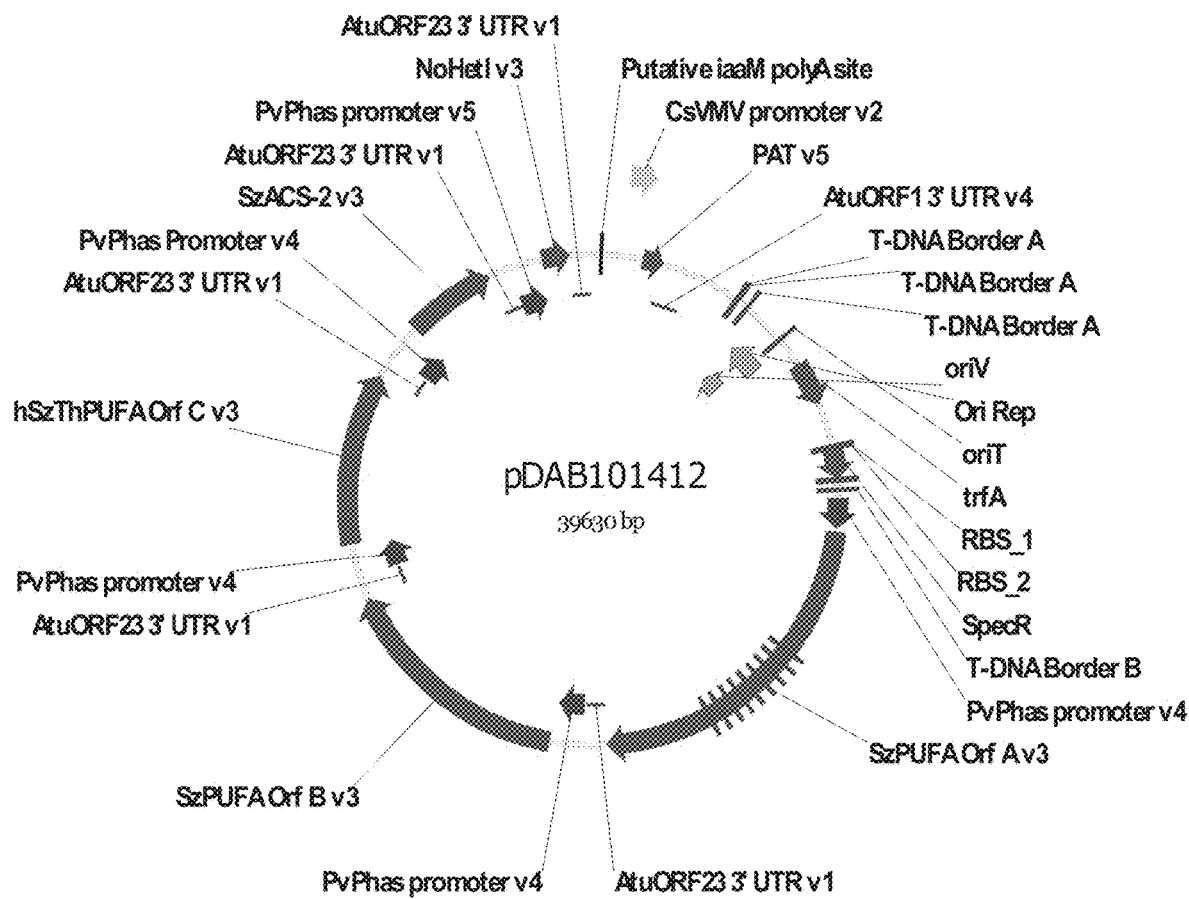
FIG. 24 is a plasmid map of pDAB101412.

Construction of pDAB101412 pDAB101412 is a binary plasmid that was constructed to contain rebuilt, codon optimized versions of SzPUFA OrfA, SzPUFA OrfB, hSzThPUFA OrfC, SzACS-2, and NoHetI. The version of the phaseolin promoter used in this construct was modified essentially as described in Bustos et al., 1989 (The Plant Cell, Vol. 1; 839-853), wherein the 5' portion of the promoter was truncated and the phaseolin 5' untranslated region was left intact. The truncated phaseolin promoter sequences are identified throughout this application as version 4 (v4), version 5 (v5), and version 6 (v6). The pDAB101412 plasmid (FIG. 24; SEQ ID NO:50) was constructed using a multi-site Gateway L-R recombination reaction.

pDAB101412 contains three PUFA synthase PTUs, one acyl-CoA synthetase PTU, one phosphopantetheinyl transferase PTU and a phosphinothricin acetyl transferase PTU. Specifically, the first PUFA synthase PTU contains the PvPhas Promoter v4, PvPhas 5' UTR, SzPUFA OrfA v3 and AtuORF23 3' UTR v1. The second PUFA synthase PTU contains the PvPhas Promoter v4, PvPhas 5' UTR, SzPUFA OrfB v3 and AtuORF23 3' UTR v1. The third PUFA synthase PTU contains the PvPhas Promoter v4, PvPhas 5' UTR, hSzThPUFA OrfC v3 and AtuORF23 3' UTR v1. The acyl-CoA synthetase PTU contains the PvPhas Promoter v4, PvPhas 5' UTR, 2S 5' UTR, SzACS-2 v3 gene and AtuORF23 5' UTR v1. The phosphopantetheinyl transferase PTU contains the PvPhas Promoter v5, PvPhas 5' UTR, NoHetI v3 and AtuORF23 3' UTR v1.

Plasmids pDAB7375, pDAB7376, pDAB7377, pDAB7398 and pDAB7333 were recombined to form pDAB101412. Specifically, the five PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, SzACS-2 v3, NoHetI v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the six PTUs with restriction enzyme digestion and DNA sequencing.

Soybean Transformation with Promoters that Express Early in Seed Development

The plasmids are used to stably transform soybean plants using the protocols described above. Transgenic soybean plants are isolated and molecularly characterized. The use of alternative constructs result in soybean plants that contain greater amounts of DHA and LC-PUFAs. The resulting LC-PUFA accumulation is determined and soybean plants that produce 0.01% to 15% DHA or 0.01% to 15% LC-PUFA are identified.

Example 9

Expression of the Algal PUFA Synthase Gene Suite Using Alternative Construct Designs Introducing Promoter Diversity to Reduce the Duplication of Regulatory Elements Gene silencing is a phenomenon that has been observed in progeny generations of transgenic soybean events. Several review articles discuss Transcriptional Gene Silencing (TGS) and Post Transcriptional Gene Silencing (PTGS), such as those of Waterhouse I., 2001 (Nature 411:834-842), Vaucheret and Fagard, 2001 (Trends in Genetics 17(0:29-35, and Okamoto and Hirochika, 2001 (Trends in Plant Sci. 6 (11): 527-534). In plants, gene silencing can be triggered by the duplication of transgenic polynucleotide sequences (tandem repeat transgene sequences, inverted repeat transgene sequences, or multiple insertions into the chromosome) or when a sequence homologous to the target gene sequences is carried either by an infecting plant virus or by the T-DNA of *Agrobacterium tumefaciens*.

In addition, the duplication of transgene polynucleotide sequences can act as triggers for construct instability. Multiple transgene sequences that share high levels of sequence similarity can fold back on one another. Rearrangements can occur via homologous recombination, wherein intervening sequences of DNA are excised. As a result, fragments of DNA that are located between repeated transgene polynucleotide sequences are excised.

One strategy in designing plasmid vectors is to introduce promoter diversity into a construct by incorporating multiple, unique seed specific promoters that maintain high level expression of each transgene. Introducing promoter sequence diversity into the plasmid vectors can reduce gene silencing and improve plasmid stability. Multiple seed specific promoters include PvDlec2, Phaseolin, and Napin (U.S. Pat. No. 5,608,152). These promoters are relatively comparable in promoter activity such as tissue specificity, levels of expression, duration of expression, etc.

Example 9.1

Construction of pDAB7733

Figure 25:
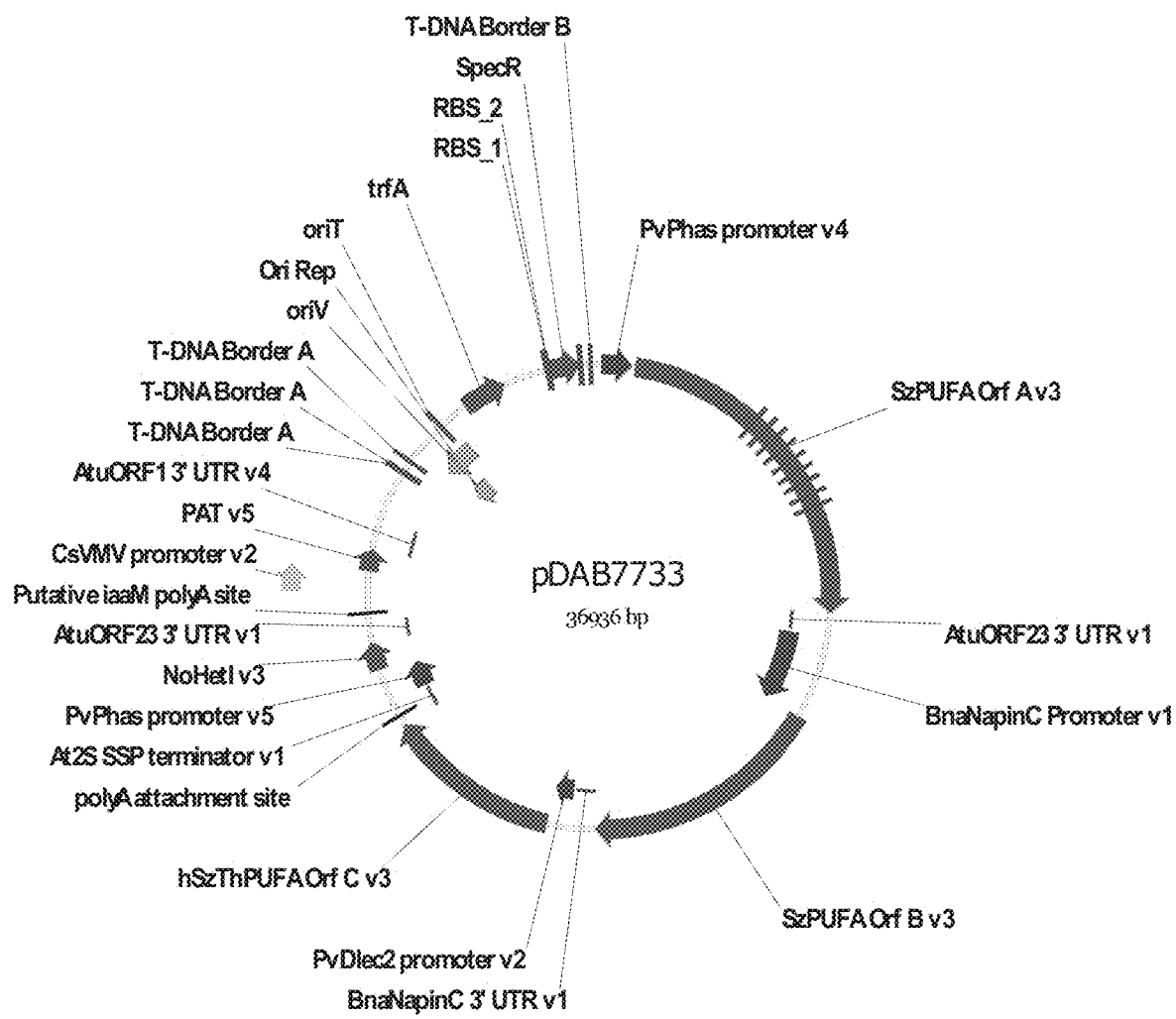
FIG. 25 is a plasmid map of pDAB7733.

The pDAB7733 binary plasmid (FIG. 25; SEQ ID NO:51) was constructed using a multi-site Gateway L-R recombination reaction. pDAB7733 contains three PUFA synthase PTUs, one phosphopantetheinyl transferase PTU and a phosphinothricin acetyl transferase PTU. Specifically, the first PUFA synthase PTU contains the PvPhas promoter v4, PvPhas 5' UTR, SzPUFA OrfA v3 and AtuORF23 3' UTR v1. The second PUFA synthase PTU contains the BnaNapinC promoter v1, BnaNapinC 5' UTR, SzPUFA OrfB v3 and BnaNapinC 3' UTR v1. The third PUFA synthase PTU contains the PvDlec2 promoter v2, 2S 5' UTR, hSzThPUFA OrfC v3 and At2S SSP terminator v1. The phosphopantetheinyl transferase PTU contains the PvPhas promoter v5, PvPhas 5' UTR, NoHetI v3 and AtuOrf23 3' UTR v1.

Plasmids pDAB7375, pDAB7731, pDAB7336, pDAB7378 and pDAB7333 were recombined to form pDAB7733. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3'

UTR v4 in addition to other regulatory elements such as Overdrive and T-strand border sequences (T-DNA Border A and T-DNA Border B). Recombinant plasmids containing the five PTUs were then isolated and tested for incorporation of the five PTUs with restriction enzyme digestion and DNA sequencing.

Example 9.2

Construction of pDAB7734

Figure 26:
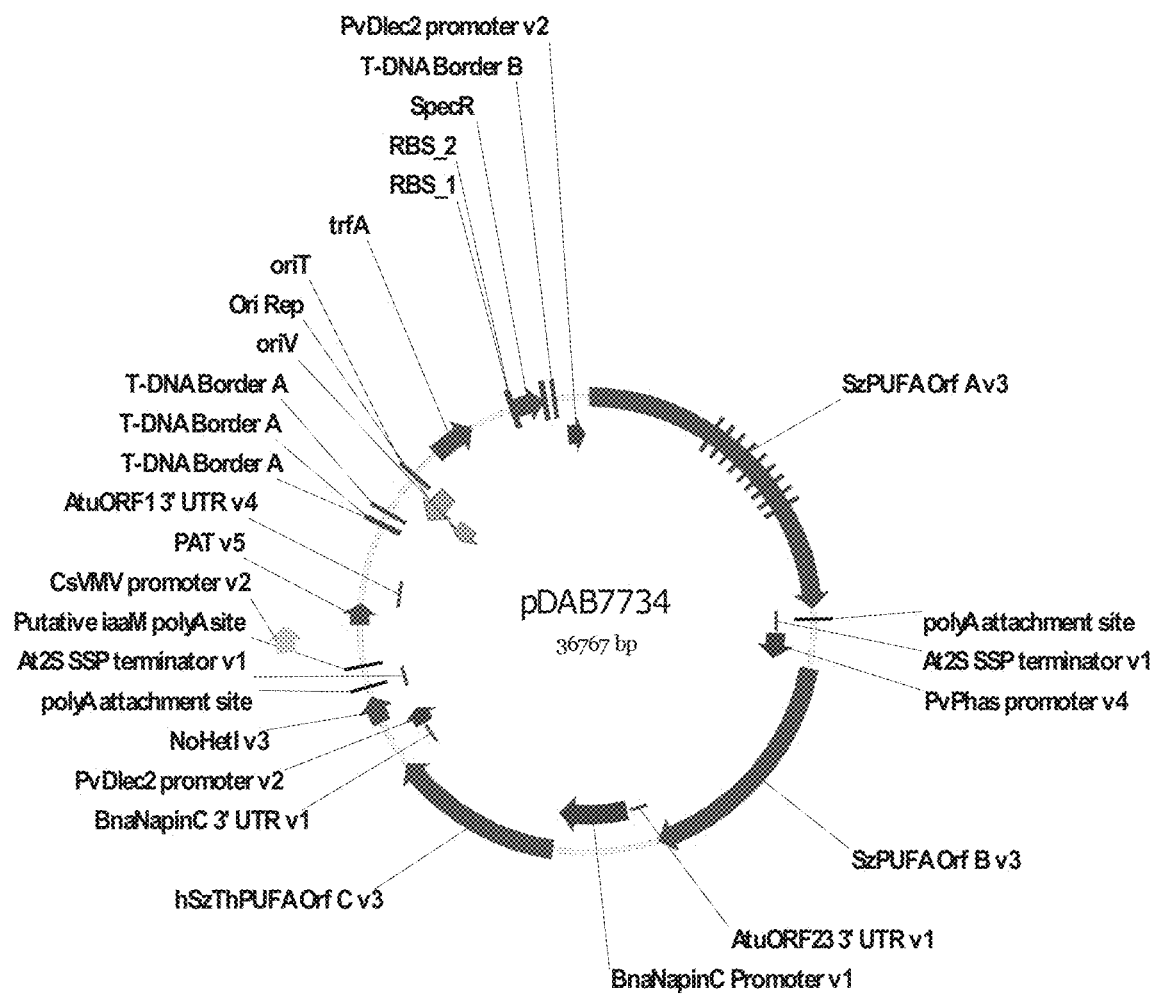
FIG. 26 is a plasmid map of pDAB7734.

The pDAB7734 binary plasmid (FIG. 26; SEQ ID NO:52) was constructed using a multi-site Gateway L-R recombination reaction. pDAB7734 contains three PUFA synthase PTUs, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The second PUFA synthase PTU contains the PvPhas promoter v4, PvPhas 5' UTR, SzPUFA OrfB v3 and AtuORF23 3' UTR v1. The third PUFA synthase PTU contains the BnaNapinC promoter v1, BnaNapinC 5' UTR, hSzThPUFA OrfC v3 and BnaNapinC 3' UTR v1. The phosphopantetheinyl transferase PTU contains the PvDlec2 promoter v2, 2S 5' UTR, NoHetI v3 and At2S SSP terminator v1.

Plasmids pDAB7334, pDAB7376, pDAB7732, pDAB7338 and pDAB7333 were recombined to form pDAB7734. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the five PTUs with restriction enzyme digestion and DNA sequencing.

Example 9.3

Construction of pDAB101493

Figure 27:
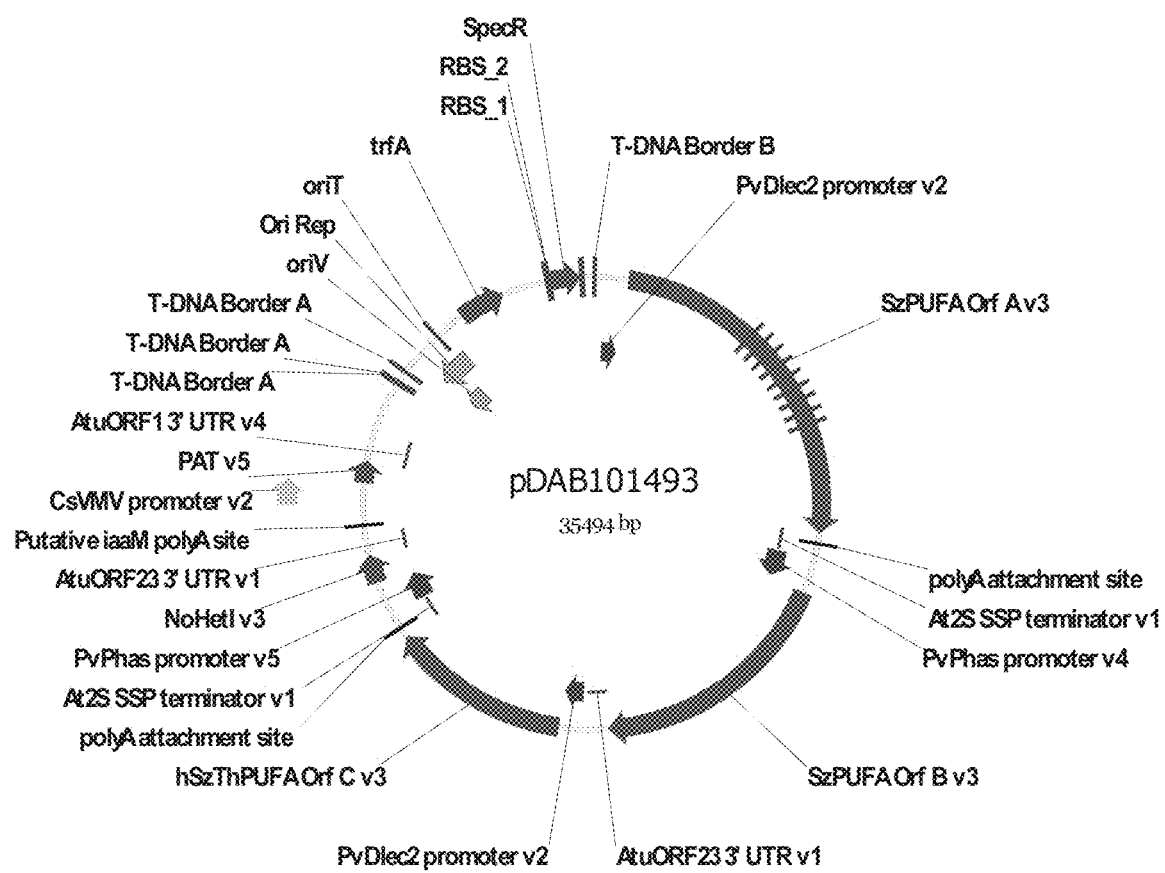
FIG. 27 is a plasmid map of pDAB101493.

The pDAB101493 binary plasmid (FIG. 27; SEQ ID NO:53) was constructed using a multi-site Gateway L-R recombination reaction. pDAB101493 contains three PUFA synthase PTUs, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The second PUFA synthase PTU contains the PvPhas promoter v4, PvPhas 5' UTR, SzPUFA OrfB v3 and AtuORF23 3' UTR v1. The third PUFA synthase PTU contains the PvDlec2 promoter v2, 2S 5' UTR, hSzThPUFA OrfC v3 and At2S SSP terminator v1. The phosphopantetheinyl transferase PTU contains the PvPhas promoter v5, PvPhas 5' UTR, NoHetI v3 and AtuOrf23 3' UTR v1.

Plasmids pDAB7334, pDAB7376, pDAB7336, pDAB7378 and pDAB7333 were recombined to form pDAB101493. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3'UTR v4 in addition to other regulatory elements such as Overdrive and T-strand border sequences (T-DNA Border A and T-DNA Border B). Recombinant plasmids containing the five PTUs were then isolated and tested for incorporation of the five PTUs with restriction enzyme digestion and DNA sequencing.

Example 9.4

Construction of pDAB109507

Figure 28:
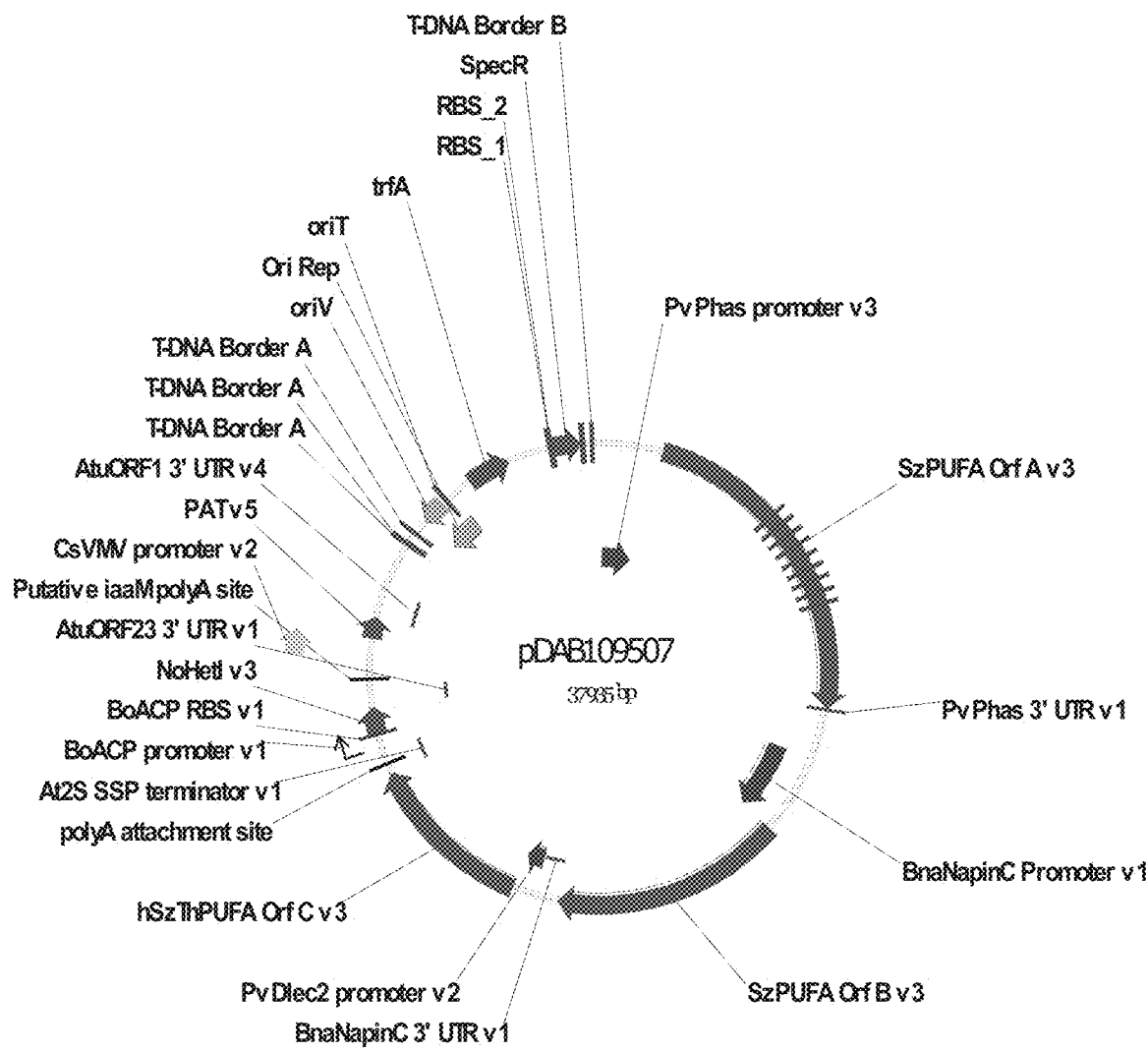
FIG. 28 is a plasmid map of pDAB109507.

The pDAB109507 plasmid (FIG. 28; SEQ ID NO:54) was constructed using a multi-site Gateway L-R recombination reaction. pDAB109507 contains three PUFA synthase PTUs, one phosphopantetheinyl transferase PTU and a phosphinothricin acetyl transferase PTU. Specifically, the first PUFA synthase PTU contains the PvPhas promoter v3, PvPhas 5' UTR, SzPUFA OrfA v3 and PvPhas 3' UTR v1 and PvPhas 3' MAR v2 (unannotated on the plasmid map). The second PUFA synthase PTU contains the BnaNapinC promoter v1, BnaNapinC 5' UTR, SzPUFA OrfB v3 and BnaNapinC 3' UTR v1. The third PUFA synthase PTU contains the PvDlec2 promoter v2, 2S 5' UTR, hSzThPUFA OrfC v3 and At2S SSP terminator v1. The phosphopantetheinyl transferase PTU contains the BoACP promoter/5' UTR v1, NoHetI v3 and AtuOrf23 3' UTR v1.

Plasmids pDAB9324, pDAB7731, pDAB7336, pDAB101485 and pDAB7333 were recombined to form pDAB109507. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the five PTUs with restriction enzyme digestion and DNA sequencing.

Example 9.5

Construction of pDAB109508

Figure 29:
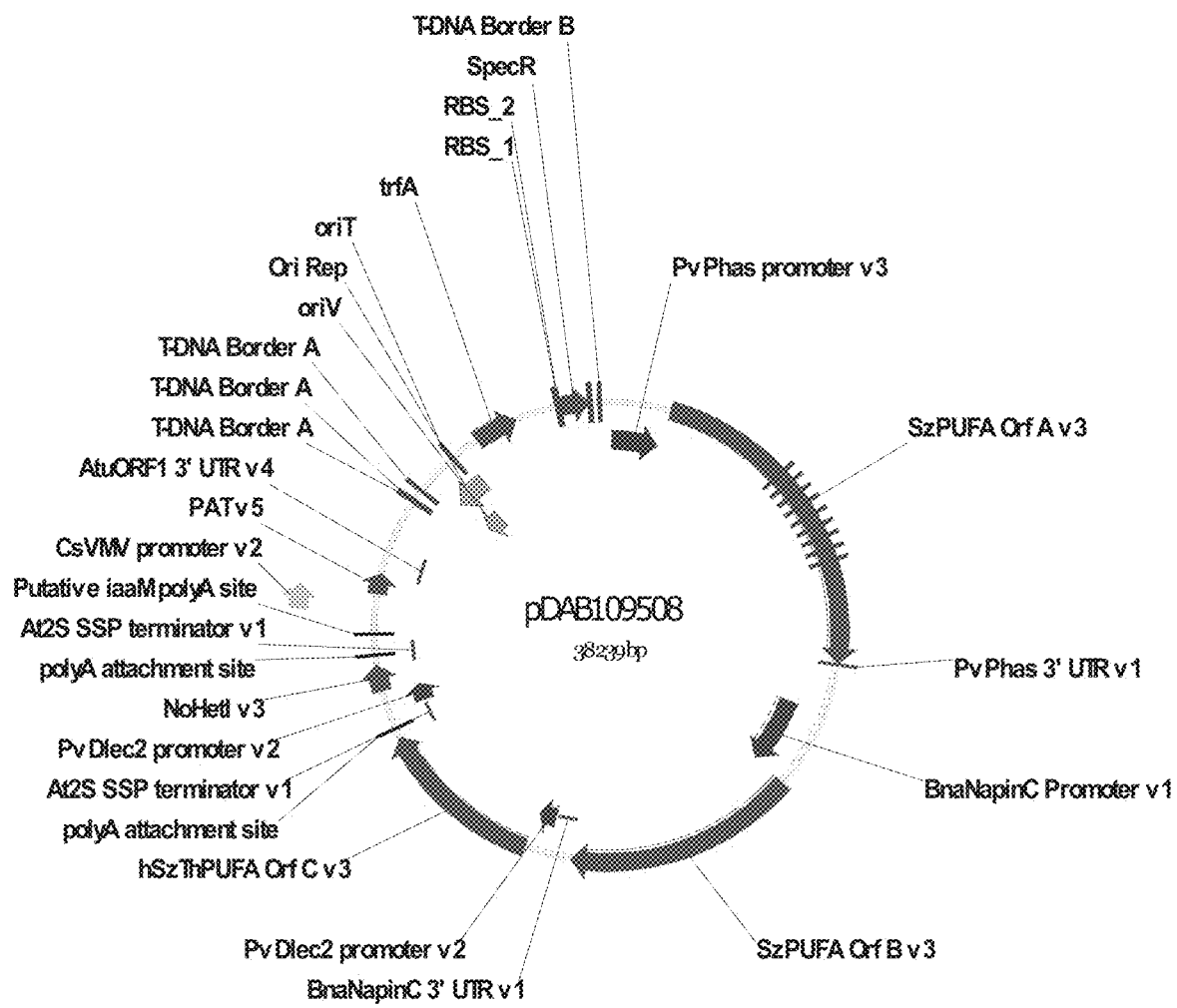
FIG. 29 is a plasmid map of pDAB109508.

The pDAB109508 plasmid (FIG. 29; SEQ ID NO:55) was constructed using a multi-site Gateway L-R recombination reaction. pDAB109508 contains three PUFA synthase PTUs, one phosphopantetheinyl transferase PTU and a phosphinothricin acetyl transferase PTU. Specifically, the first PUFA synthase PTU contains the PvPhas promoter v3, PvPhas 5' UTR, SzPUFA OrfA v3 and PvPhas 3' UTR v1 and PvPhas 3' MAR v2 (unannotated on the plasmid map). The second PUFA synthase PTU contains the BnaNapinC promoter v1, BnaNapinC 5' UTR, SzPUFA OrfB v3 and BnaNapinC 3' UTR v1. The third PUFA synthase PTU contains the PvDlec2 promoter v2, 2S 5' UTR, hSzThPUFA OrfC v3 and At2S SSP terminator v1. The phosphopantetheinyl transferase PTU contains the PvDlec2 promoter v2, 2S 5' UTR, NoHetI v3 and At2S SSP terminator v1.

Plasmids pDAB9324, pDAB7731, pDAB7336, pDAB7338 and pDAB7333 were recombined to form pDAB109508. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the five PTUs with restriction enzyme digestion and DNA sequencing.

Example 9.6

Construction of pDAB109509

Figure 30:
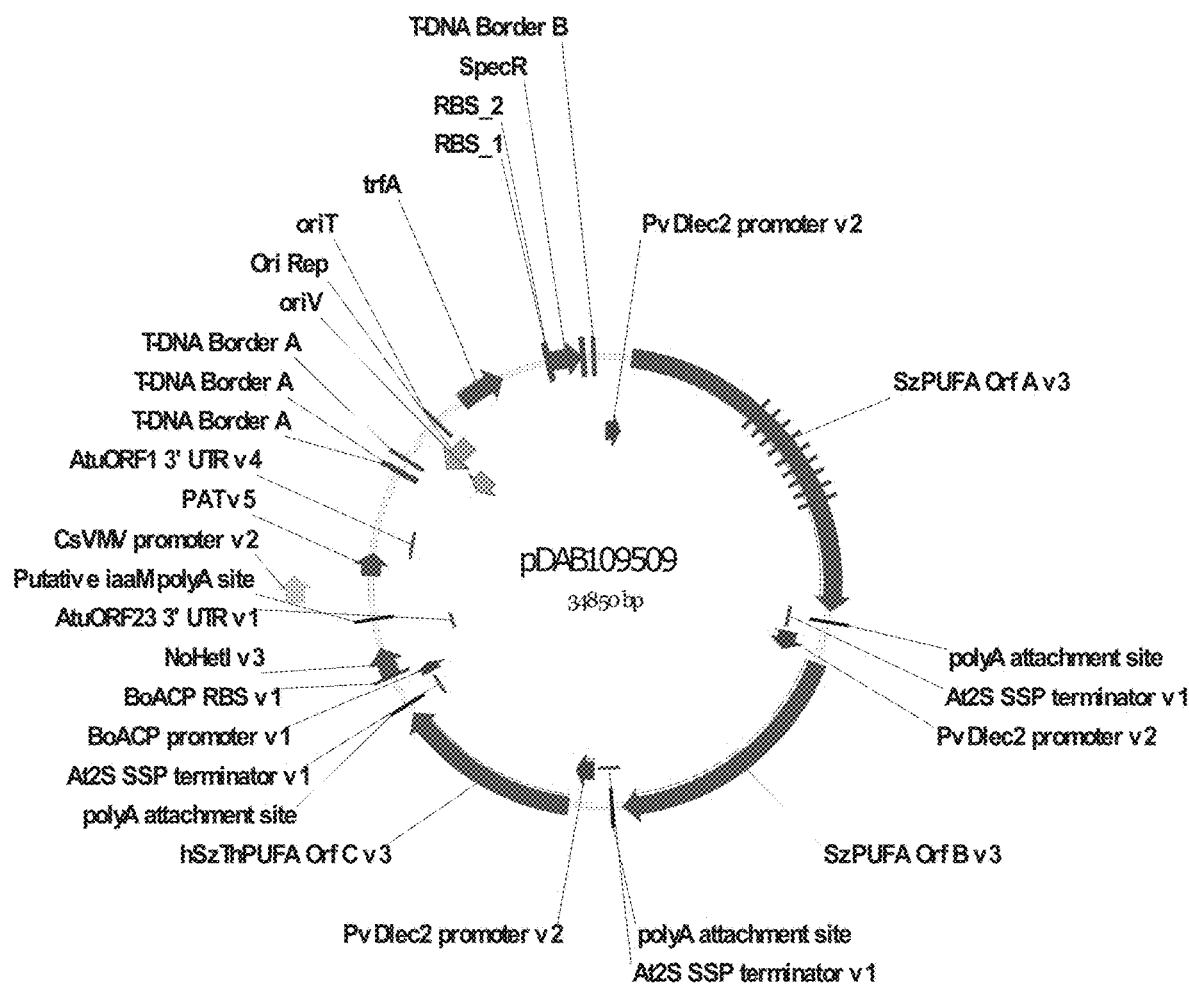
FIG. 30 is a plasmid map of pDAB109509.

The pDAB109509 plasmid (FIG. 30; SEQ ID NO:56) was constructed using a multi-site Gateway L-R recombination reaction. pDAB109509 contains three PUFA synthase PTUs, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The second PUFA synthase PTU contains the PvDlec2 promoter v2, 2S 5' UTR, SzPUFA OrfB v3 and At2S SSP terminator v1. The third PUFA synthase PTU contains the PvDlec2 promoter v2, 2S 5' UTR, hSzThPUFA OrfC v3 and At2S SSP terminator v1. The phosphopantetheinyl transferase PTU contains the BoACP promoter/5' UTR v1, NoHetI v3 and AtuOrf23 3' UTR v1.

Plasmids pDAB7334, pDAB7335, pDAB7336, pDAB101485 and pDAB7333 were recombined to form pDAB109509. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the five PTUs with restriction enzyme digestion and DNA sequencing.

Rearranging the Order of the Binary Construct PTUs to Reduce Fragmentation of Long Gene Sequences The SzPUFA OrfA PTU was placed at the 3' end of the binary construct to test whether the order of the PTU cassettes could reduce fragmentation and rearrangements in isolated transgenic events. SzPUFA OrfA is a large open reading frame (~8,700 b.p.) containing nine tandem acyl carrier protein repeats. In the first series of completed constructs, the SzPUFA OrfA PTU was positioned to be integrated first into the plant chromosome. The SzPUFA OrfA PTU was subsequently followed by the remaining PUFA synthesis-related gene PTUs as they decreased in molecular size. Molecular analysis of the SzPUFA OrfA coding region indicated that some transgenic canola and *Arabidopsis thaliana* events contained fragmented insertions. Alternative Construct Designs are described, wherein the order of the PUFA synthase PTUs has been changed to the following configuration; hSzThPUFA OrfC PTU, SzPUFA OrfB PTU, NoHetI PTU, SzPUFA OrfA PTU, and PAT PTU. Changing the location of the SzPUFA OrfA PTU on the binary construct is completed to reduce fragmentation and rearrangement in isolated transgenic events.

Example 9.7

Construction of pDAB9151

Figure 31:
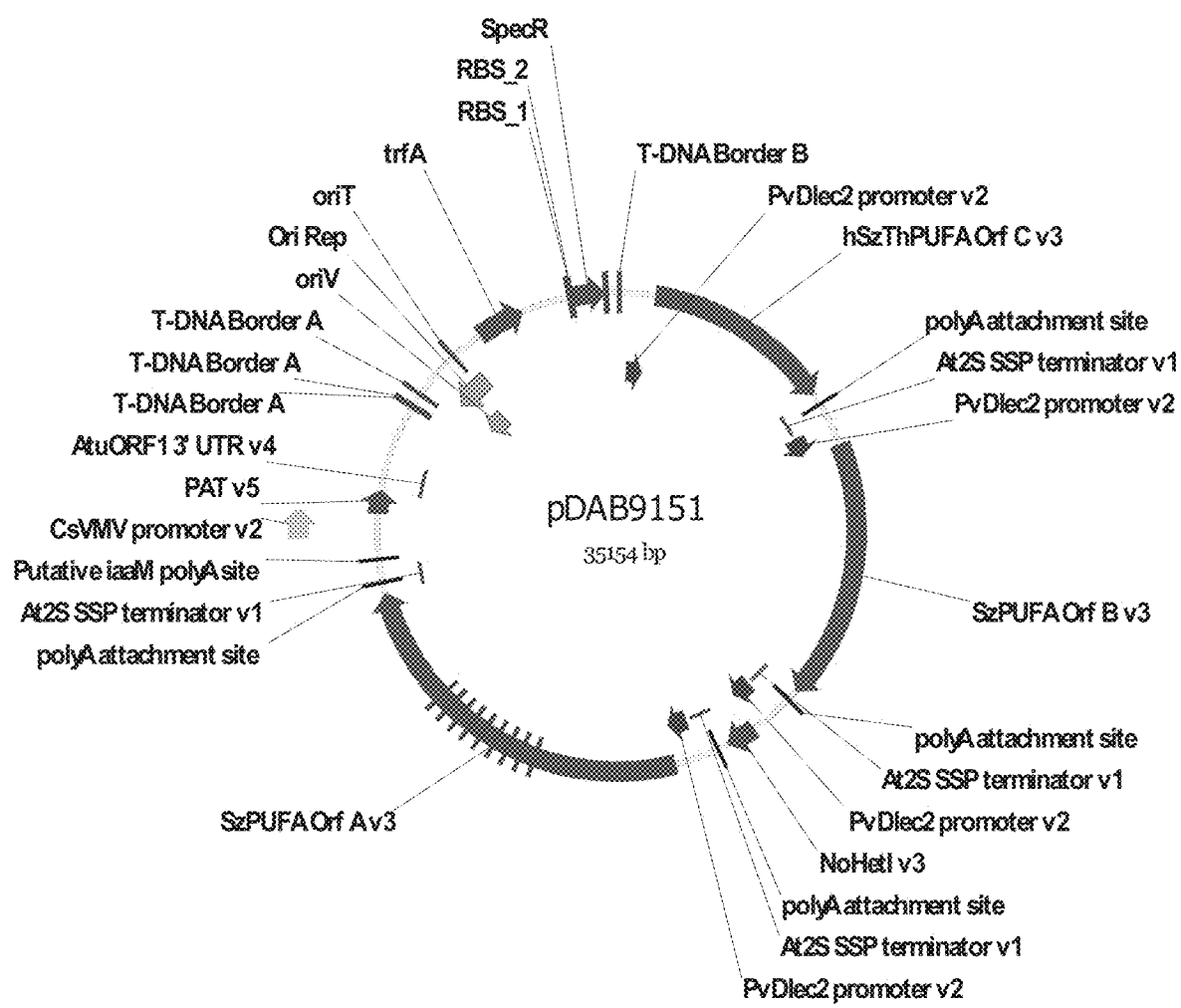
FIG. 31 is a plasmid map of pDAB9151.

The pDAB9151 plasmid (FIG. 31; SEQ ID NO:57) was constructed using a multi-site Gateway L-R recombination reaction. pDAB9151 contains three PUFA synthase PTUs, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfB v3 and At2S SSP terminator v1. The second PUFA synthase PTU contains the PvDlec2 promoter v2, 2S 5' UTR, hSzThPUFA OrfC v3 and At2S SSP terminator v1. The phosphopantetheinyl transferase PTU contains the PvDlec2 promoter v2, 2S 5' UTR, NoHetI v3 and At2S SSP terminator v1. The final PUFA synthase PTU contains the PvDlec2 promoter v2, 2S 5' UTR, SzPUFA OrfA v3 and At2S SSP terminator v1.

Plasmids pDAB9148, pDAB7335, pDAB9149, pDAB9150 and pDAB7333 were recombined to form pDAB9151. Specifically, the four PTUs described above were placed in a head-to-tail orientation within the T-strand DNA border regions of the plant transformation binary pDAB7333. The order of the genes is: hSzThPUFA OrfC v3, SzPUFA OrfB v3, NoHetI v3, SzPUFA OrfA v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the five PTUs with restriction enzyme digestion and DNA sequencing.

Change the Transcriptional Direction of the Binary Construct PTUs to Introduce Construct Diversity An alternative construct design includes changing the order of PUFA synthase PTUs and the transcriptional direction of the gene expression cassettes. In the first series of completed constructs, each gene expression cassette was positioned in the same direction ("head to tail," wherein the promoter of one gene expression cassette is located adjacent to the 3' UTR of a second gene expression cassette). The following constructs describe a strategy wherein, gene expression cassettes are positioned in different directions, and utilize alternative promoters. In these examples, the gene expression cassette is located in trans to a second gene expression cassette such that the promoters of both gene expression cassettes are engineered adjacent to one another. This configuration is described as a "head-to-head" configuration. Other configurations are described in the examples, wherein one gene expression cassette is located in trans to a second gene expression cassette such that the 3' UTRs of both gene expression cassettes are engineered adjacent to one another. This configuration is described as a "tail-to-tail" configuration. To mitigate potential read-through of such a design, the bidirectional Orf 23/24 terminator has been placed between these two PTUs. These configurations are proposed to increase expression of the transgenes, thereby resulting in higher concentrations and content of LC-PUFA and DHA fatty acid.

Example 9.8

Construction of pDAB108207

Figure 32:
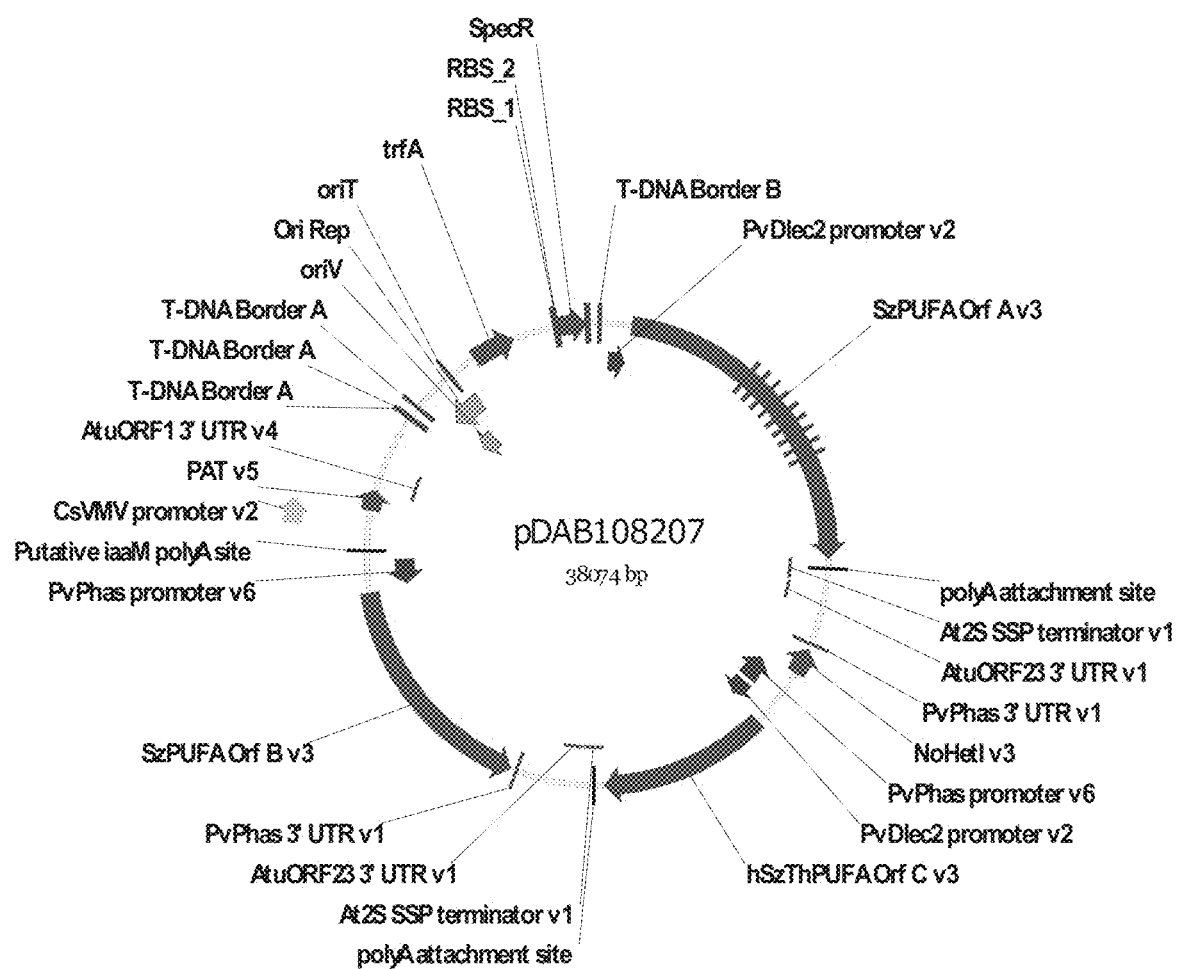
FIG. 32 is a plasmid map of pDAB108207.

The pDAB108207 plasmid (FIG. 32; SEQ ID NO:58) was constructed using a multi-site Gateway L-R recombination reaction. pDAB108207 contains three PUFA synthase PTUs, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The phosphopantetheinyl transferase PTU contains the PvPhas promoter v6, PvPhas 5' UTR, NoHetI v3, PvPhas 3' UTR v1 and PvPhas 3' MAR v2 (unannotated on the plasmid map). The second PUFA synthase PTU contains the PvDlec2 promoter v2, 2S 5' UTR, hSzThPUFA OrfC v3, At2S SSP terminator v1 and AtuORF23 3' UTR v1. The third PUFA synthase PTU contains the PvPhas promoter v6, PvPhas 5' UTR, SzPUFA OrfB v3, PvPhas 3' UTR and PvPhas 3' MAR v2 (unannotated on the plasmid map) and AtuORF23 3' UTR v1.

Plasmids pDAB7334, pDAB101489, pDAB108205, pDAB108206 and pDAB7333 were recombined to form pDAB108207. Specifically, the SzPUFA OrfA v3 and NoHetI v3 are placed in a tail-to-tail orientation; NoHetI v3 and hSzThPUFA OrfC v3 are placed in a head-to-head orientation; hSzThPUFA OrfC v3 and SzPUFA OrfB are placed in a tail-to-tail orientation within the T-strand DNA border regions of the plant transformation binary pDAB7333. The order of the genes is: SzPUFA OrfA v3, NoHetI v3, hSzThPUFA OrfC v3, SzPUFA OrfB v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the five PTUs with restriction enzyme digestion and DNA sequencing.

Example 9.9

Construction of pDAB108208

Figure 33:
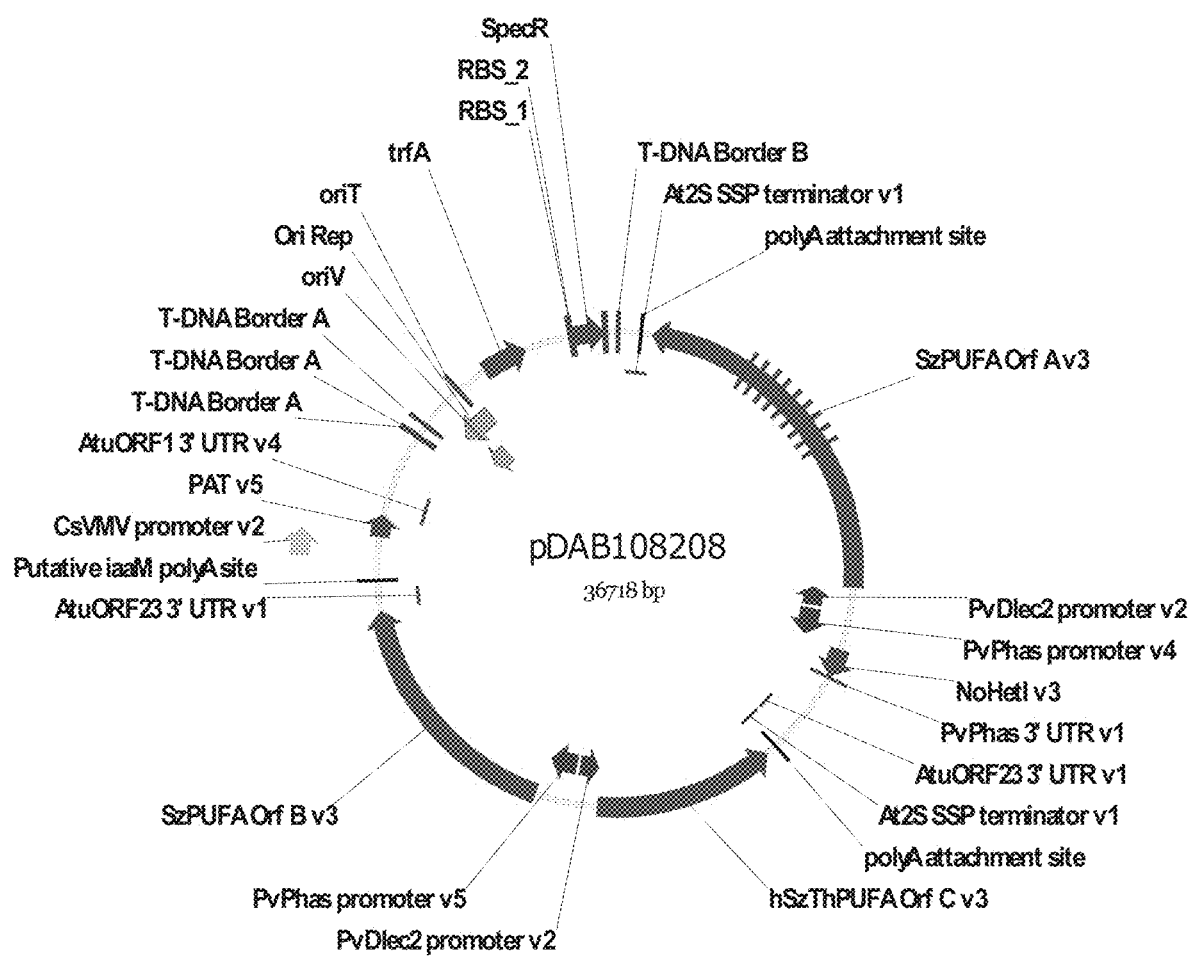
FIG. 33 is a plasmid map of pDAB108208.

The pDAB108208 plasmid (FIG. 33; SEQ ID NO:59) was constructed using a multi-site Gateway L-R recombination reaction. pDAB108208 contains three PUFA synthase PTUs, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The phosphopantetheinyl transferase PTU contains the PvPhas promoter v4, PvPhas 5' UTR, NoHetI v3 and AtuORF23 3' UTR v1. The second PUFA synthase PTU contains the PvDlec2 promoter v2, 2S 5' UTR, hSzThPUFA OrfC v3 and At2S SSP terminator v1. The third PUFA synthase PTU contains the PvPhas promoter v5, PvPhas 5' UTR, SzPUFA OrfB v3, PvPhas 3' UTR, PvPhas 3' MAR v2 (unannotated on the plasmid map), and AtuORF23 3' UTR v1.

Plasmids pDAB108200, pDAB101490, pDAB108201, pDAB108202 and pDAB7333 were recombined to form pDAB108208. Specifically, the SzPUFA OrfA v3 and NoHetI v3 are placed in a head-to-head orientation; NoHetI v3 and hSzThPUFA OrfC v3 are placed in a tail-to-tail orientation; hSzThPUFA OrfC v3 and SzPUFA OrfB are placed in a head-to-head orientation within the T-strand DNA border regions of the plant transformation binary pDAB7333. The order of the genes is: SzPUFA OrfA v3, NoHetI v3, hSzThPUFA OrfC v3, SzPUFA OrfB v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the five PTUs with restriction enzyme digestion and DNA sequencing.

Example 9.10

Construction of pDAB108209

Figure 34:
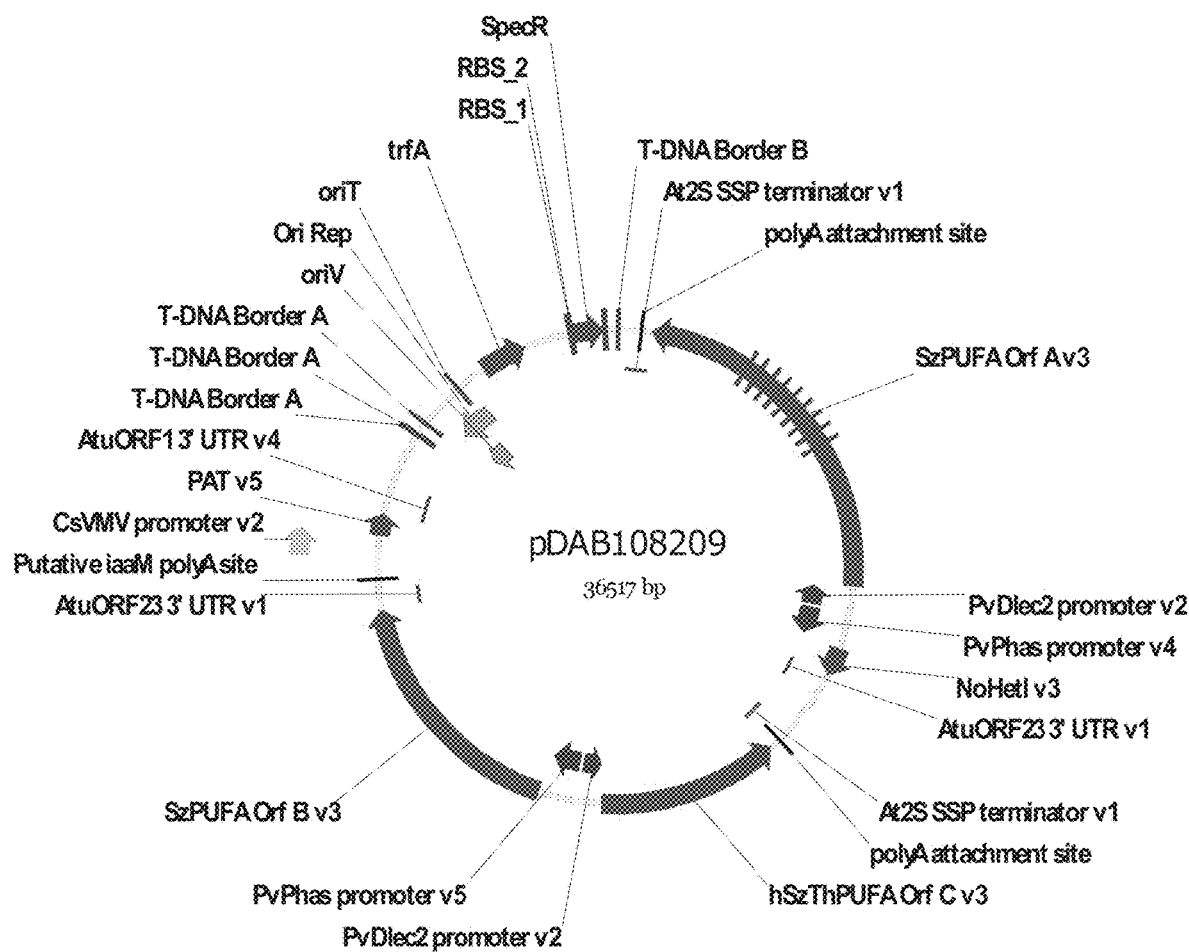
FIG. 34 is a plasmid map of pDAB108209.

The pDAB108209 plasmid (FIG. 34; SEQ ID NO:60) was constructed using a multi-site Gateway L-R recombination reaction. pDAB108209 contains three PUFA synthase PTUs, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The phosphopantetheinyl transferase PTU contains the PvPhas promoter v4, PvPhas 5' UTR, NoHetI v3 and AtuORF23 3' UTR v1. The second PUFA synthase PTU contains the PvDlec2 promoter v2, 2S 5' UTR, hSzThPUFA OrfC v3 and At2S SSP terminator v1. The third PUFA synthase PTU contains the PvPhas promoter v5, PvPhas 5' UTR, SzPUFA OrfB v3, PvPhas 3' UTR and PvPhas 3' MAR v2 (unannotated on the plasmid map), and random DNA spacer.

Plasmids pDAB108200, pDAB108204, pDAB108201, pDAB108202 and pDAB7333 were recombined to form pDAB108209. Specifically, the SzPUFA OrfA v3 and NoHetI v3 are placed in a head-to-head orientation; NoHetI v3 and hSzThPUFA OrfC v3 are placed in a tail-to-tail orientation; hSzThPUFA OrfC v3 and SzPUFA OrfB are placed in a head-to-head orientation within the T-strand DNA border regions of the plant transformation binary pDAB7333. The order of the genes is: SzPUFA OrfA v3, NoHetI v3, hSzThPUFA OrfC v3, SzPUFA OrfB v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the five PTUs with restriction enzyme digestion and DNA sequencing.

Doubling 3' UTRs and Including Spacer DNA to Minimize Transcriptional Interference.

Transcriptional interference can occur when multiple genes are stacked in a series thereby resulting in reduced expression of the downstream genes. This phenomenon results from transcriptional read-through of the 3' UTR and terminator into the next promoter-transcription unit. Alternative construct designs consisting of two strategies to minimize transcriptional interference and transcriptional interference are described. The first strategy deploys the use of two terminator/3' UTRs, which are stacked between individual DHA gene expression cassettes to limit read-through into the next gene expression cassette. The second strategy inserts about one-thousand base pairs of spacer DNA between gene expression cassettes, thereby minimizing transcriptional interference.

Example 9.11

Construction of pDAB108207

The pDAB108207 plasmid (FIG. 32; SEQ ID NO:58) was constructed using a multi-site Gateway L-R recombination reaction. pDAB108207 contains three PUFA synthase PTUs, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The second PUFA synthase PTU contains the PvPhas promoter v3, PvPhas 5' UTR, SzPUFA OrfB v3, PvPhas 3' UTR, PvPhas 3' MAR v2 (unannotated on the plasmid map), and AtuORF23 3' UTR v1. The third PUFA synthase PTU contains the PvDlec2 promoter v2, 2S 5' UTR, hSzThPUFA OrfC v3, At2S SSP terminator v1 and AtuORF23 3' UTR v1. The phosphopantetheinyl transferase PTU contains the PvPhas promoter v6, PvPhas 5' UTR, NoHetI v3, PvPhas 3' UTR v1 and PvPhas 3' MAR v2 (unannotated on the plasmid map).

Plasmids pDAB7334, pDAB101489, pDAB108205, pDAB108206 and pDAB7333 were recombined to form pDAB108207. Specifically, the SzPUFA OrfA v3 and NoHetI v3 are placed in a tail-to-tail orientation and an AtuORF23 3' UTR is placed between the two PTUs; NoHetI v3 and hSzThPUFA OrfC v3 are placed in a head-to-head orientation; hSzThPUFA OrfC v3 and SzPUFA OrfB are placed in a head-to-tail orientation and an AtuORF23 3' UTR is placed between the two PTUs within the T-strand DNA border regions of the plant transformation binary pDAB7333. The order of the genes is: SzPUFA OrfA v3, NoHetI v3, hSzThPUFA OrfC v3, SzPUFA OrfB v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the five PTUs with restriction enzyme digestion and DNA sequencing.

Example 9.12

Construction of pDAB108208

The pDAB108208 plasmid (FIG. 33; SEQ ID NO:59) was constructed using a multi-site Gateway L-R recombination reaction. pDAB108208 contains three PUFA synthase PTUs, one acyl-CoA synthetase PTU, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The second PUFA synthase PTU contains the PvPhas promoter v5, PvPhas 5' UTR, SzPUFA OrfB v3, PvPhas 3' UTR, PvPhas 3' MAR v2 (unannotated on the plasmid map) and AtuORF23 3' UTR v1. The third PUPA synthase PTU contains the PvDlec2 promoter v2, 2S 5' UTR, hSzThPUFA OrfC v3 and At2S SSP terminator v1. The phosphopantetheinyl transferase PTU contains the PvPhas promoter v4, PvPhas 5' UTR, NoHetI v3 and AtuORF23 3' UTR v1.

Plasmids pDAB108200, pDAB101490, pDAB108201, pDAB108202 and pDAB7333 were recombined to form pDAB108208. Specifically, the SzPUFA OrfA v3 and NoHetI v3 are placed in a head-to-head orientation; NoHetI v3 and hSzThPUFA OrfC v3 are placed in a tail-to-tail orientation and an AtuORF23 3' UTR is placed between the two PTUs; hSzThPUFA OrfC v3 and SzPUFA OrfB are placed in a head-to-head orientation within the T-strand DNA border regions of the plant transformation binary pDAB7333. The order of the genes is: SzPUFA OrfA v3, NoHetI v3, hSzThPUFA OrfC v3, SzPUFA OrfB v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the five PTUs with restriction enzyme digestion and DNA sequencing.

Example 9.13

Construction of pDAB108209

The pDAB108209 plasmid (FIG. 34; SEQ ID NO:60) was constructed using a multi-site Gateway L-R recombination reaction. pDAB108209 contains three PUFA synthase PTUs, one acyl-CoA synthetase PTU, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The second PUFA synthase PTU contains the PvPhas promoter v5, PvPhas 5' UTR, SzPUFA OrfB v3, PvPhas 3' UTR, PvPhas 3' MAR v2 (unannotated on the plasmid map), and random DNA spacer. The third PUFA synthase PTU contains the PvDlec2 promoter v2, 2S 5' UTR, hSzThPUFA OrfC v3 and At2S SSP terminator v1. The phosphopantetheinyl transferase PTU contains the PvPhas promoter v4, PvPhas 5' UTR, NoHetI v3 and AtuORF23 3' UTR v1.

Plasmids pDAB108200, pDAB108204, pDAB108201, pDAB108202 and pDAB7333 were recombined to form pDAB108209. Specifically, the SzPUFA OrfA v3 and NoHetI v3 are placed in a head-to-head orientation; NoHetI v3 and hSzThPUFA OrfC v3 are placed in a tail-to-tail orientation and a one-thousand base pair spacer is placed between the two PTUs; hSzThPUFA OrfC v3 and SzPUFA OrfB are placed in a head-to-head orientation within the T-strand DNA border regions of the plant transformation binary pDAB7333. The order of the genes is: SzPUFA OrfA v3, NoHetI v3, hSzThPUFA OrfC v3, SzPUFA OrfB v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the five PTUs with restriction enzyme digestion and DNA sequencing.

Using Alternative 3' UTR-Terminator to Limit Transcriptional Read-Through.

The *Agrobacterium* ORF 23 3' UTR-terminator is primarily used to terminate transcription in many of the above constructs. It was recently shown the ZmLipase 3' UTR-terminator is more effective in terminating transcriptional read-through in *Arabidopsis thaliana*. As such, one version of constructs utilizes the ZmLipase 3' UTR-terminator in combination with the PvDlec2 promoter to test if this 3' UTR can reduce transcriptional read-through of upstream genes, thereby reducing transcriptional interference.

Example 9.14

Construction of pDAB9159

Figure 35:
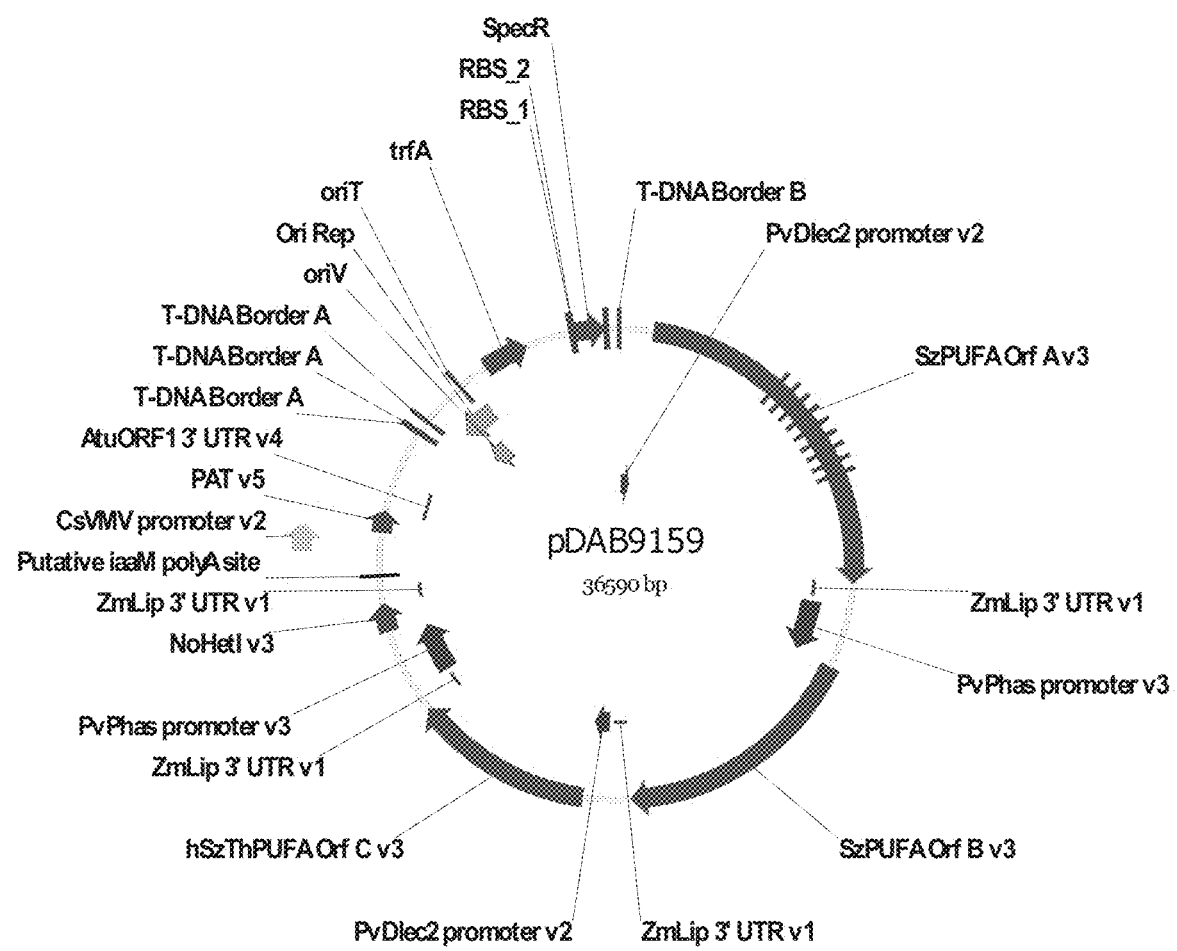
FIG. 35 is a plasmid map of pDAB9159.

The pDAB9159 plasmid (FIG. 35; SEQ ID NO:61) was constructed using a multi-site Gateway L-R recombination reaction. pDAB9159 contains three PUFA synthase PTUs, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and ZmLip 3' UTR v1. The second PUFA synthase PTU contains the PvPhas promoter v3, PvPhas 5' UTR, SzPUFA OrfB v3 and ZmLip 3' UTR v1. The third PUFA synthase PTU contains the PvDlec2 promoter v2, 2S 5' UTR, hSzThPUFA OrfC v3 and ZmLip 3' UTR v1. The phosphopantetheinyl transferase PTU contains the PvPhas promoter v3, PvPhas 5' UTR, NoHetI v3 and ZmLip 3' UTR v1.

Plasmids pDAB9152, pDAB9153, pDAB9154, pDAB9155 and pDAB7333 were recombined to form pDAB9159. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the five PTUs with restriction enzyme digestion and DNA sequencing.

Example 9.15

Construction of pDAB9147

Figure 36:
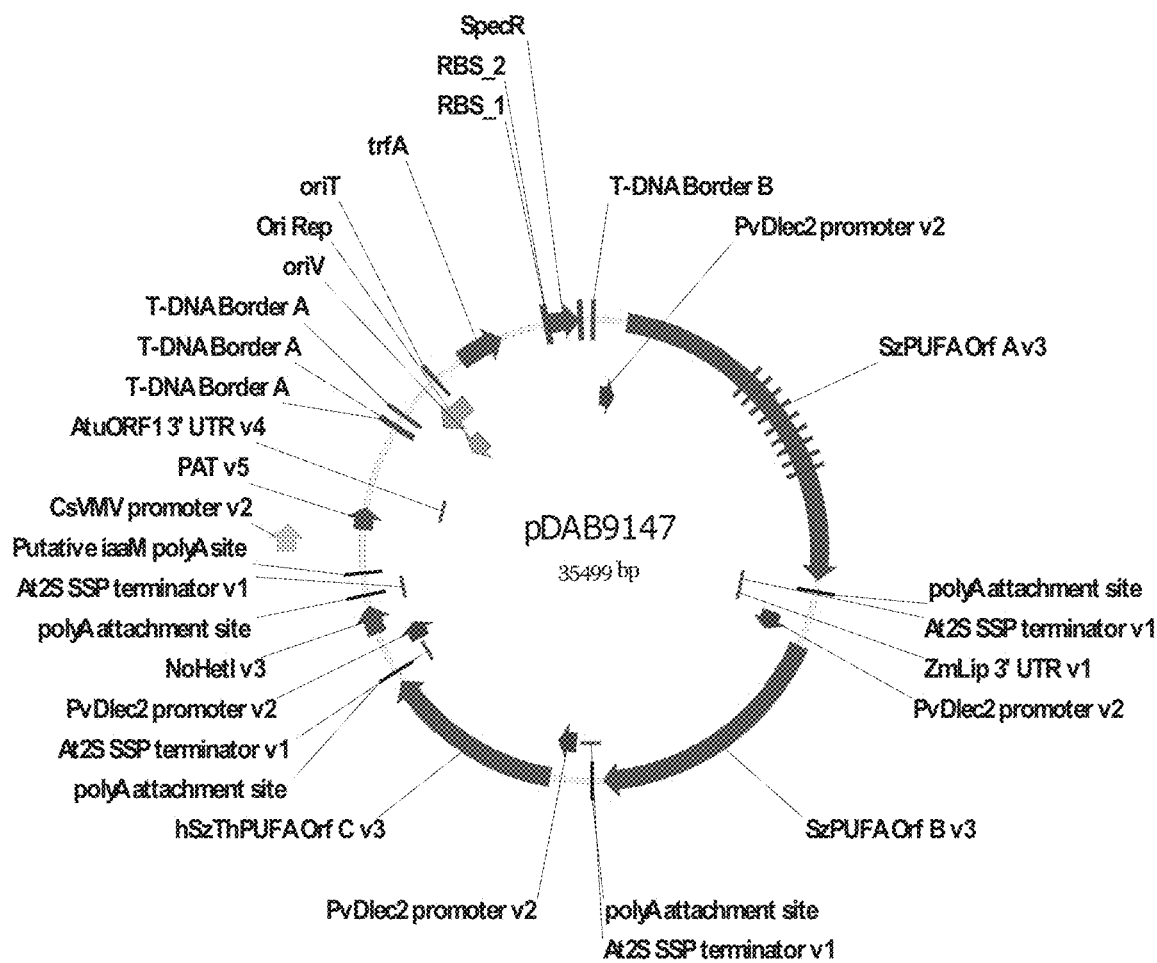
FIG. 36 is a plasmid map of pDAB9147.

The pDAB9147 plasmid (FIG. 36; SEQ ID NO:62) was constructed using a multi-site Gateway L-R recombination reaction. pDAB9147 contains three PUFA synthase PTUs, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3, At2S SSP terminator v1 and ZmLip 3' UTR v1. The second PUFA synthase PTU contains the PvDlec2 promoter v2, 2S 5' UTR, SzPUFA OrfB v3 and At2S SSP terminator v1. The third PUFA synthase PTU contains the PvDlec2 promoter v2, 2S 5' UTR, hSzThPUFA OrfC v3 and At2S SSP terminator v1. The phosphopanteth-einyl transferase PTU contains the PvDlec2 promoter v2, 2S 5' UTR, NoHetI v3 and At2S SSP terminator v1.

Plasmids pDAB9146, pDAB7335, pDAB7336, pDAB7338 and pDAB7333 were recombined to form pDAB9147. Specifically, the four PTUs described above were placed in a head-to-tail orientation within the T-strand DNA border regions of the plant transformation binary pDAB7333. The order of the genes is: SzPUFA OrfA v3, SzPUFA OrfB v3, hSzThPUFA OrfC v3, NoHetI v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the five PTUs with restriction enzyme digestion and DNA sequencing.

Delivery of DHA Genes on Two Separate T-DNAs.

An alternative construct design consists of constructing two separate binary vectors, the first vector containing a sub-set of PUFA synthase genes on one T-DNA, and the second binary vector containing the remaining PUFA synthase genes on a second T-DNA. These binary vectors are individually used to transform plants that are sexually crossed, thereby resulting in progeny that contain all of the PUFA synthase gene expression constructs. An alternative method to produce transgenic plants would be to co-transform both binary vectors into soybean tissue, and select or screen for a single plant that contains both T-strands.

Example 9.16

Construction of pDAB108224

Figure 37:
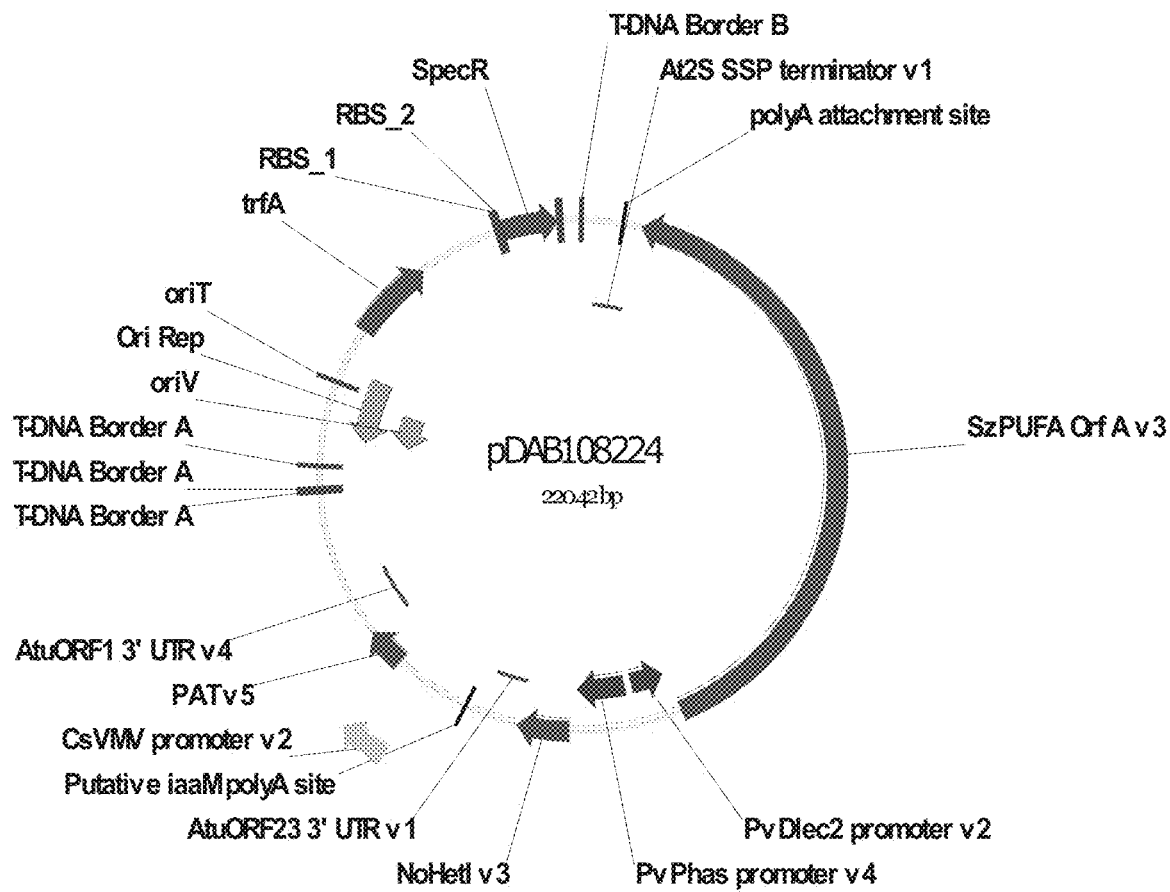
FIG. 37 is a plasmid map of pDAB108224.

The pDAB108224 plasmid (FIG. 37; SEQ ID NO:63) was constructed using a multi-site Gateway L-R recombination reaction. pDAB108224 contains one PUFA synthase PTU, one phosphopantetheinyl transferase PTU and a phosphinothricin acetyl transferase PTU. Specifically, the first PUFA synthase PTU contains the PvDlec2 promoter v2, 2S 5' UTR, SzPUFA OrfA v3 and At2S SSP terminator v1. The phosphopantetheinyl transferase PTU contains the PvPhas promoter v4, PvPhas 5' UTR, NoHetI v3 and AtuORF23 3' UTR v1.

Plasmids pDAB108216, pDAB108221 and pDAB7333 were recombined to form pDAB108224. Specifically, the SzPUFA OrfA v3 and NoHetI v3 are placed in a head-to-head orientation within the T-strand DNA border regions of the plant transformation binary pDAB7333. The order of the genes is: SzPUFA OrfA v3, NoHetI v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the three PTUs with restriction enzyme digestion and DNA sequencing.

Example 9.17

Construction of pDAB108225

Figure 38:
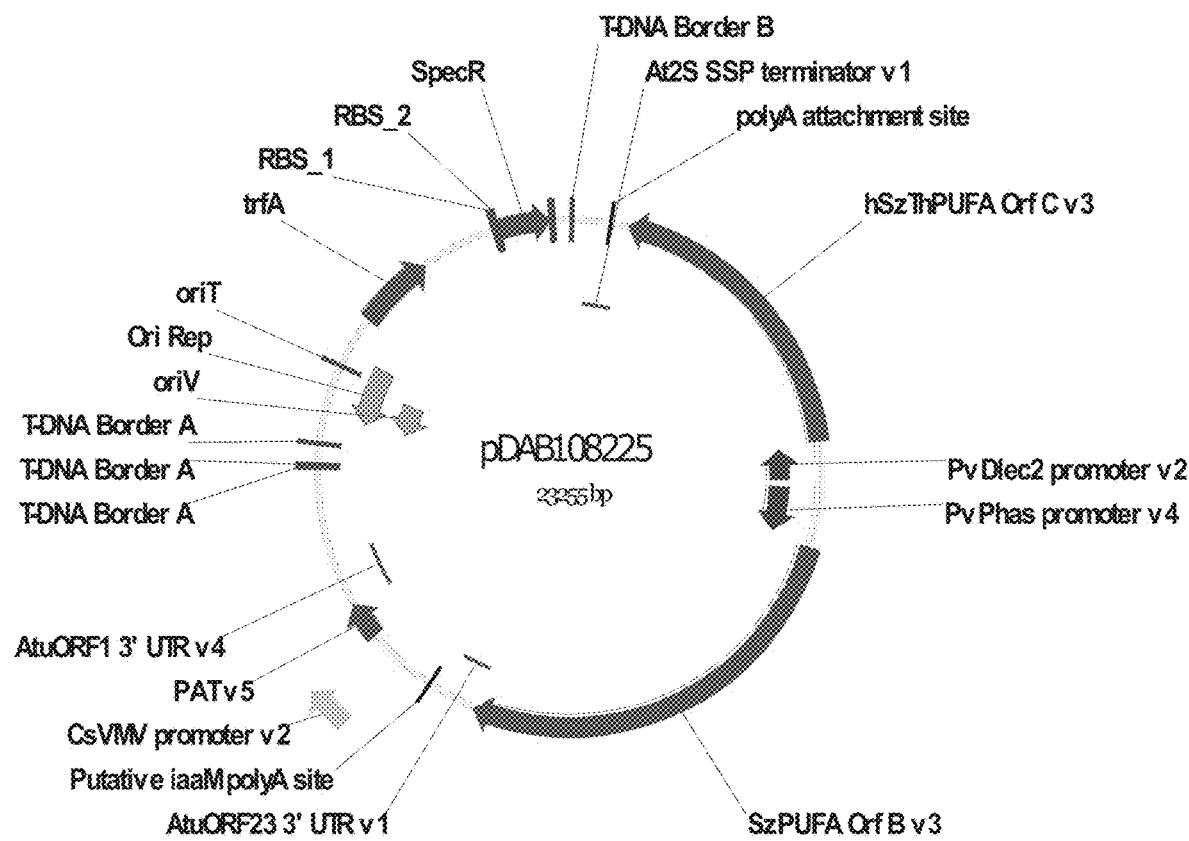
FIG. 38 is a plasmid map of pDAB108225.

The pDAB108225 plasmid (FIG. 38; SEQ ID NO:64) was constructed using a multi-site Gateway L-R recombination reaction. pDAB108225 contains two PUFA synthase PTUs and a phosphinothricin acetyl transferase PTU. Specifically, the first PUFA synthase PTU contains the PvDlec2 promoter v2, 2S 5' UTR, SzPUFA OrfB v3 and At2S SSP terminator v1. The second PUFA synthase PTU contains the PvPhas promoter v4, SzPUFA OrfB v3 and Atu ORF23 3' UTR v1.

Plasmids pDAB108217, pDAB108222 and pDAB7333 were recombined to form pDAB108225. Specifically, the SzPUFA (MB v3 and hSzThPUFA OrfC v3 are placed in a head-to-head orientation within the T-strand DNA border regions of the plant transformation binary pDAB7333. The order of the genes is: SzPUFA OrfB v3, hSzThPUFA OrfC v3. pDAB7333 also contains the phosphinothricin acetyl transferase PTU: CsVMV promoter v2, PAT v5, AtuORF1 3' UTR v4 in addition to other regulatory elements such as Overdrive and T-strand border sequences (T-DNA Border A and T-DNA Border B). Recombinant plasmids containing the five PTUs were then isolated and tested for incorporation of the three PTUs with restriction enzyme digestion and DNA sequencing.

Soybean Transformation with Constructs Containing Alternative Designs

These plasmids are used to stably transform soybean plants using the protocols described above. Transgenic soybean plants are isolated and molecularly characterized. The use of alternative constructs result in soybean plants that contain greater amounts of DHA and LC-PUFAs. The resulting LC-PUFA accumulation is determined and soybean plants that produce 0.01% to 15% DHA or 0.01% to 15% LC-PUFA are identified.

Example 10

Alternative Construct Designs Used for Transformation of *Arabidopsis thaliana* and Subsequent Production of LC-PUFA and DHA

Figure 39:
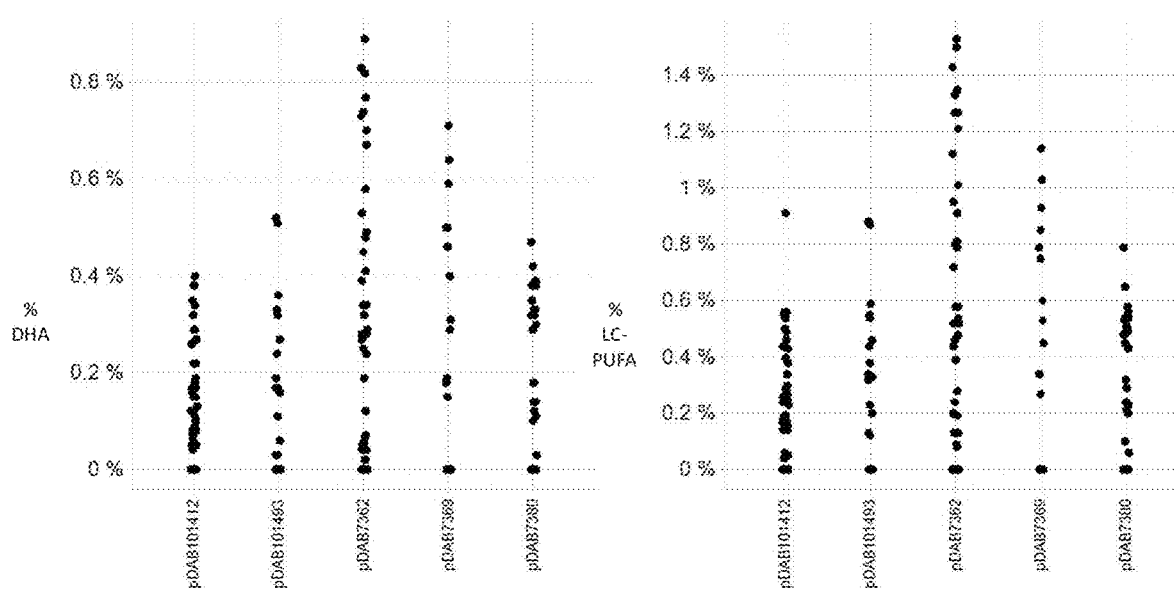
FIG. 39 shows DHA and LC-PUFA content of T2 seed from individual transgenic *Arabidopsis* events transformed with pDAB101493, pDAB7362, pDAB7369, pDAB101412 or pDAB7380.

*Arabidopsis thaliana* plants were transformed with *Agrobacterium tumefaciens* strains containing the pDAB101493, pDAB7362, pDAB7369, pDAB101412, or pDAB7380 binary vectors. A floral dipping transformation protocol described by Clough and Bent (1998) was used for the transformation. Clough and Bent, "Floral dip: a simplified method for *agrobacterium*-mediated transformation of *Arabidopsis thalia*," Plant J., 16:735-743, 1998. Transformed *Arabidopsis* plants were obtained and molecular confirmation of the transgene presence was completed. $T_1$ plants from the transgenic *Arabidopsis* events were grown to maturity in the greenhouse. These plants were self-fertilized and the resulting $T_2$ seed harvested at maturity, $T_2$ seeds (10 mg) were analyzed via FAMEs GC-FID to determine the LC-PUFA and DHA content in the $T_2$ *Arabidopsis* seed. The tissue was analyzed via the FAMEs GC-FID method as described in the previous examples. $T_2$ seeds from a $T_1$ plant of the *Arabidopsis* plants contained from 0% to 0.95% DHA and 0% to 1.50% total LC-PUFA. The LC-PUFA and DHA content of the $T_2$ seed from individual $T_1$ plants is shown in FIG. 39.

Example 11

Co-Expression of DGAT2 or ACCase with the Algal PUFA Synthase Gene Suite within Soybean Oil content within soybean plants is further modified by transformation of chimeric DNA molecules that encode and express an acetyl CoA carboxylase (ACCase) or a type 2 diacylglycerol acyltransferase (DGAT2). These genes are co-expressed with the algal PUFA synthase genes described above, either through breeding soybean plants containing the ACCase or DGAT2 expression cassette with soybean plants containing the PUFA synthase genes; or by transforming soybean plants with a gene stack containing the ACCase or DGAT2 and the PUFA synthase genes. Regulatory elements necessary for expression of an ACCase or DGAT2 coding sequence can include those described above. Additional regulatory elements expression sequences known in the art may also be used. The ACCase and DGAT2 expression cassettes are transformed into soybean using transformation protocols described above. Transformation may occur as molecular stacks of the ACCase or DGAT2 expression cassette combined with the PUFA synthase OrfA, PUFA synthase OrfB, PUFA synthase OrfC, acyl-CoA synthetase and 4' phosphopantetheinyl transferase HetI expression cassettes; or as independent ACCase or DGAT2 expression cassettes linked to a selectable marker and then subsequently crossed with soybean plants that contain the PUFA synthase OrfA, PUFA synthase OrfB, PUFA synthase OrfC, acyl-CoA synthetase and 4' phosphopantetheinyl transferase HetI expression cassettes. Positive transformants are isolated and molecularly characterized. Soybean plants are identified that contain increased accumulation of LC-PUFAs in the plant, the seed of the plant, or plant oil concentrations compared to untransformed control soybean plants. Such increases can range from a 1.2 to a 20-fold increase.

The over-expression of ACCase in the cytoplasm may produce higher levels of malonyl-CoA. Soybean plants or seed containing increased levels of cytoplasmic malonyl-CoA may produce subsequently higher levels of the long-chain polyunsaturated fatty acid (LC-PUFA) when the algal PUFA synthase genes are present and expressed. DGAT2 genes that are expressed within soybean plants may be capable of preferentially incorporating significant amounts of docosahexaenoic acid (DHA) and eicosapentaenoic acid (EPA) into triacylglycerol. DGAT2 genes with substrate preference toward LC-PUFAs (see, e.g., PCT International Publication WO 2009/085169 A2) may increase incorporation of these fatty acids into triacylglycerol (TAG). Such DGAT genes are useful for directing the incorporation of LC-PUFA, particularly DHA, into TAG and for increasing the production of TAG in plants and other organisms.

Example 12

Production of DHA in *Arabidopsis* Seeds Transformed with Alternative Construct Designs for Expression of PUFA Synthase Genes

*Arabidopsis* $T_1$ events transformed with *Agrobacterium tumefaciens* harboring plasmids encoding PUFA synthase genes and HetI (and in some cases SzACS-2) under the control of various plant expression elements were generated using the floral dip method essentially as described in Clough and Bent (Plant J., 1998 16(6):735-43). The resulting $T_1$ seed was harvested and sown. Transformed $T_1$ plants were selected by spraying with phosphinothricin to select for those plants containing a functional PAT gene as a selectable marker. Leaf tissue from the surviving $T_1$ plants was sampled and analyzed by quantitative PCR reactions specific for the PAT gene to identify those plants containing a single copy of the selectable marker (and associated transgenes). These plants were grown to maturity, the $T_2$ seed harvested and analyzed for LC-PUFA content (as % of total extractable FAMEs). A summary of data from the events generated with various constructs encoding PUFA synthase genes is shown in Table 12.

TABLE 12

*Arabidopsis* events containing a single copy of the PAT transgene producing LC-PUFA in $T_2$ seeds and the levels of DHA and EPA for each event, shown as a percentage of total oil.

| Construct | # of events generated | # of events producing LC-PUFA | # of events with LC-PUFA >1% [1] | Average LC-PUFA content [2] | Maximum LC-PUFA content | Maximum DHA content [3] | Maximum EPA content [4] | Average n-3/PUFA ratio [5] |
|---|---|---|---|---|---|---|---|---|
| pDAB9167 | 30 | 9 (30%) | 0 | 0.06 | 0.24 | 0.17 | 0 | 67% |
| pDAB101477 | 11 | 2 (18%) | 0 | 0.07 | 0.49 | 0.29 | 0 | 64% |
| pDAB101412 | 63 | 33 (52%) | 0 | 0.17 | 0.91 | 0.40 | 0.07 | 68% |
| pDAB7380 | 45 | 23 (51%) | 0 | 0.23 | 0.79 | 0.47 | 0.12 | 69% |

TABLE 12-continued

*Arabidopsis* events containing a single copy of the PAT transgene producing LC-PUFA in $T_2$ seeds and the levels of DHA and EPA for each event, shown as a percentage of total oil.

| Construct | # of events generated | # of events producing LC-PUFA | # of events with LC-PUFA >1% [1] | Average LC-PUFA content [2] | Maximum LC-PUFA content | Maximum DHA content [3] | Maximum EPA content [4] | Average n-3/PUFA ratio [5] |
|---|---|---|---|---|---|---|---|---|
| pDAB7733 | 23 | 13 (57%) | 0 | 0.24 | 1.07 | 0.69 | 0.07 | 61% |
| pDAB101493 | 25 | 15 (60%) | 0 | 0.26 | 0.88 | 0.52 | 0.13 | 75% |
| pDAB100518 | 71 | 39 (71%) | 0 | 0.27 | 0.96 | 0.64 | 0.07 | 70% |
| pDAB7362 | 126 | 45 (36%) | 10 (8%) | 0.28 | 1.73 | 1.02 | 0.26 | 64% |
| pDAB9151 | 35 | 15 (43%) | 3 (9%) | 0.29 | 1.39 | 0.84 | 0.11 | 74% |
| pDAB9147 | 40 | 19 (48%) | 3 (8%) | 0.36 | 1.62 | 0.89 | 0.10 | 70% |
| pDAB9159 | 46 | 32 (70%) | 0 | 0.43 | 1.07 | 0.68 | 0.13 | 72% |
| pDAB109509 | 32 | 21 (66%) | 1 (3%) | 0.44 | 1.14 | 0.79 | 0.17 | 67% |
| pDAB7734 | 45 | 27 (60%) | 8 (18%) | 0.49 | 1.62 | 1.00 | 0.13 | 76% |
| pDAB7369 | 42 | 26 (62%) | 5 (12%) | 0.50 | 1.47 | 0.88 | 0.11 | 66% |
| pDAB108209 | 46 | 36 (78%) | 2 (4%) | 0.62 | 1.61 | 1.01 | 0.29 | 70% |
| pDAB109508 | 29 | 20 (69%) | 7 (24%) | 0.68 | 1.72 | 1.02 | 0.13 | 64% |
| pDAB108208 | 46 | 33 (72%) | 21 (46%) | 0.71 | 1.33 | 0.89 | 0.18 | 73% |
| pDAB109507 | 30 | 23 (77%) | 10 (33%) | 0.77 | 2.03 | 1.45 | 0.05 | 72% |
| pDAB108207 | 47 | 35 (74%) | 16 (34%) | 0.86 | 1.82 | 0.99 | 0.16 | 64% |

[1] Number of events with LC-PUFA content >1% of total seed FAMEs with %-age of total events in parentheses.
[2] Average total LC-PUFA content (DHA(n-3) + EPA(n-3) + DPA (n-6)) of all T2 seed samples as % of total seed FAMEs
[3] Maximum DHA content of all $T_2$ seed samples analyzed as % of total FAMEs
[4] Maximum EPA content of all $T_2$ seed samples analyzed as % of total FAMEs
[5] Average n-3 LC-PUFA (DHA + EPA)/Total LC-PUFA content across all LC-PUFA-producing events (as %)

These data show that certain construct configurations and promoter combinations generate a higher proportion of events containing LC-PUFA in the $T_2$ seed (77% of all single copy events for pDAB109507 produced DHA, and 86% of all single copy events for pDAB108207 produced DHA). Also certain constructs generate a higher proportion of events producing >1% LC-PUFA content (33% of all single copy events for pDAB109507, and 34% of all single copy events for pDAB108207). The maximum LC-PUFA content of the $T_2$ seed from the various events ranged from 0.24%-2.03% for the different constructs. Likewise, certain constructs produce higher levels of omega-3 LC-PUFAs. The maximum DHA content ranged from 0.17%-1.45% and the maximum EPA content ranged from 0%-0.26% across all the constructs and events generated. These data indicate that the alteration of the construct design where promoter configurations were changed resulted in transgenic plants that exhibit increased LC-PUFA, as compared to transgenic plants that were transformed with pDAB7362. As such, these constructs in which the construct design was altered are desirable for crop transformations.

$T_2$ seed from high LC-PUFA producing events was planted and the leaf tissue from the growing plants was sampled using quantitative PCR to assay the PAT gene and other transgenes. Plants containing two copies of the transgenes (i.e., homozygotes) were identified and grown to maturity. The resulting $T_3$ seed was harvested and analyzed for LC-PUFA content. Some constructs such as pDAB7362 and pDAB109509, which contained repeated promoter/3' UTR expression elements, showed poor stability of the LC-PUFA trait in the subsequent $T_3$ seed generation. However, some events transformed with different construct configurations and/or diversified expression elements (e.g., pDAB108207, 109508 and 7734) produced significantly improved stability of the LC-PUFA trait into the $T_3$ seed generation, as shown in Table 13. These data indicate that certain constructs can maintain stability of the DHA trait in subsequent generations and that such constructs are preferred for crop transformations.

TABLE 13

LC-PUFA analysis of $T_3$ seed progeny from selected transgenic *Arabidopsis* DHA-producing $T_2$ lines

| Construct | Event ID | Parent $T_2$ seed DHA content | Parent $T_2$ seed LC-PUFA content | No. of homozygous progeny analyzed | Average $T_3$ seed DHA content [1] | Range of $T_3$ seed DHA content | Average $T_3$ seed LC-PUFA content | Range of $T_3$ seed LC-PUFA content |
|---|---|---|---|---|---|---|---|---|
| pDAB7362 | 5217[12]-202 | 0.66 | 1.53 | 14 | 0.03 | 0-0.10 | 0.17 | 0-0.46 |
| pDAB7362 | 5217[12]-231 | 0.89 | 1.50 | 20 | 0.04 | 0-0.28 | 0.08 | 0-0.48 |
| pDAB7362 | 5217[12]-219 | 0.77 | 1.35 | 19 | 0.03 | 0-0.17 | 0.05 | 0-0.26 |
| pDAB109509 | 109509[1]-025 | 0.79 | 1.14 | 10 | 0.13 | 0-0.31 | 0.20 | 0-0.42 |
| pDAB109509 | 109509[1]-037 | 0.61 | 1.00 | 10 | 0.15 | 0.06-0.30 | 0.21 | 0.09-0.42 |
| pDAB109509 | 109509[2]-102 | 0.73 | 1.03 | 10 | 0.09 | 0-0.36 | 0.12 | 0-0.47 |
| pDAB108207 | 108207[1]-047 | 0.93 | 1.57 | 10 | 0.89 | 0.66-1.09 | 1.43 | 0.99-1.84 |
| pDAB108207 | 108207[1]-051 | 0.99 | 1.77 | 5 | 1.08 | 0.99-1.27 | 2.05 | 1.83-2.36 |
| pDAB108207 | 108207[1]-076 | 0.97 | 1.68 | 5 | 0.88 | 0.55-1.04 | 1.64 | 1.08-1.9 |

TABLE 13-continued

LC-PUFA analysis of T₃ seed progeny from selected transgenic *Arabidopsis* DHA-producing T₂ lines

| Construct | Event ID | Parent T₂ seed DHA content | Parent T₂ seed LC-PUFA content | No. of homozygous progeny analyzed | Average T₃ seed DHA content | Range of T₃ seed DHA content[1] | Average T₃ seed LC-PUFA content | Range of T₃ seed LC-PUFA content |
|---|---|---|---|---|---|---|---|---|
| pDAB109508 | 109508[1]-028 | 1.02 | 1.72 | 10 | 1.25 | 1.16-1.39 | 1.99 | 1.86-2.09 |
| pDAB7734 | 649[1]-138 | 1 | 1.62 | 9 | 1.43 | 0.98-1.83 | 2.17 | 1.45-2.89 |

Total LC-PUFA contents and DHA contents are % of total FAMEs
[1] T₃ bulk seed from 5-20 individual homozygous plants was analyzed The foregoing description of the invention has been presented for purposes of illustration and description. Furthermore, the description is not intended to limit the invention to the form disclosed herein.

All of the various aspects, embodiments, and options described herein can be combined in any and all variations.

All publications, patents, and patent applications mentioned in this specification are herein incorporated by reference to the same extent as if each individual publication, patent, or patent application was specifically and individually indicated to be incorporated by reference.

SEQUENCE LISTING (73 sequences)

SEQ ID NO: 1 - protein, 2910 aa, Artificial sequence
  SzPUFA OrfA v3 protein
MAARLQEQKGGEMDTRIAIIGMSAILPCGTTVRESWETIRAGIDCLSDLPEDRVDVTAYFDPVKTTKDKIYCKRGGFIPEYDFDAREFGLNMFQMEDSDANQTISLLKVKEALQDAGIDALGKEKKNIGCVLGIGGGQKSSHEFYSRLNYVVVEKVLRKMGMPEEDVKVAVEKYKANFPEWRLDSFPGFLGNVTAGRCTNTFNLDGMNCVVDAACASSLIAVKVAIDELLYGDCDMMVTGATCTDNSIGMYMAFSKTPVFSTDPSVRAYDEKTKGMLIGEGSAMLVLKRYADAVRDGDEIHAVIRGCASSSDGKAAGIYTPTISGQEEALRRAYNRACVDPATVTLVEGHGTGTPVGDRIELTALRNLFDKAYGEGNTEKVAVGSIKSSIGHLKAVAGLAGMIKVIMALKHKTLPGTINVDNPPNLYDNTPINESSLYINTMNRPWFPPPGVPRRAGISSFGFGGANYHAVLEEAEPEHTTAYRLNKRPQPVLMMAATPAALQSLCEAQLKEFEAAIKENETVKNTAYIKCVKFGEQFKFPGSIPATNARLGFLVKDAEDACSTLRAICAQFAKDVTKEAWRLPREGVSFRAKGIATNGAVAALFSGQGAQYTHMFSEVAMNWPQFRQSIAAMDAAQSKVAGSDKDFERVSQVLYPRKPYEREPEQDHKKISLTAYSQPSTLACALGAFEIFKEAGFTPDFAAGHSLGEFAALYAAGCVDRDELFELVCRRARIMGGKDAPATPKGCMAAVIGPNAENIKVQAANVWLGNSNSPSQTVITGSVEGIQAESARLQKEGFRVVPLACESAFHSPQMENASSAFKDVISKVSFRTPKAETKLFSNVSGETYPTDAREMLTQHMTSSVKFLTQVRNMHQAGARIFVEFGPKQVLSKLVSETLKDDPSVVTVSVNPASGTDSDIQLRDAAVQLVVAGVNLQGFDKWDAPDATRMQAIKKKRTTLRLSAATYVSDKTKKVRDAAMNDGRCVTYLKGAAPLIKAPEPVVDEAAKREAERLQKELQDAQRQLDDAKRAAAEANSKLAAAKEEAKTAAASAKPAVDTAVVEKHRAILKSMLAELDGYGSVDASSLQQQQQQQTAPAPVKAAAPAAPVASAPAPAVSNELLEKAETVVMEVLAAKTGYETDMIEADMELETELGIDSIKRVEILSEVQAMLNVEAKDVDALSRTRTVGEVVNAMKAEIAGSSAPAPAAAAPAPAKAAPAAAAPAVSNELLEKAETVVMEVLAAKTGYETDMIESDMELETELGIDSIKRVEILSEVQAMLNVEAKDVDALSRTRTVGEVVNAMKAEIAGGSAPAPAAAAPGPAAAAPAPAAAAPAVSNELLEKAETVVMEVLAAKTGYETDMIESDMELETELGIDSIKRVEILSEVQAMLNVEAKDVDALSRTRTVGEVVDAMKAEIAGGSAPAPAAAAPAPAAAAPAPAAPAPAVSSELLEKAETVVMEVLAAKTGYETDMIESDMELETELGIDSIKRVEILSEVQAMLNVEAKDVDALSRTRTVGEVVDAMKAEIAGGSAPAPAAAAPAPAAAAPAPAAPAPAAPAPAVSSELLEKAETVVMEVLAAKTGYETDMIESDMELETELGIDSIKRVEILSEVQAMLNVEAKDVDALSRTRTVGEVVDAMKAEIAGSSASAPAAAAPAPAAAAPAPAAAAPAVSNELLEKAETVVMEVLAAKTGYETDMIESDMELETELGIDSIKRVEILSEVQAMLNVEAKDVDALSRTRTVGEVVDAMKAEIAGGSAPAPAAAAPAPAAAAPAVSNELLEKAETVVMEVLAAKTGYETDMIESDMELETELGIDSIKRVEILSEVQAMLNVEAKDVDALSRTRTVGEVVDAMKAEIAGSSAPAPAAAAPAPAAAAPAPAAAAPAVSSELLEKAETVVMEVLAAKTGYETDMIESDMELETELGIDSIKRVEILSEVQAMLNVEAKDVDALSRTRTVGEVVDAMKAEIAGGSAPAPAAAAPAPAAAAPAVSNELLEKAETVVMEVLAAKTGYETDMIESDMELETELGIDSIKRVEILSEVQAMLNVEAKDVDALSRTRTVGEVVDAMKAEIAGGSAPAPAAAAPASAGAAPAVKIDSVHGADCDDLSLMHAKVVDIRRPDELILERPENRPVLVVDDGSELTLALVRVLGACAVVLTFEGLQLAQRAGAAAIRHVLAKDLSAESAEKAIKEAEQRFGALGGFISQQAERFEPAEILGFTLMCAKFAKASLCTAVAGGRPAFIGVARLDGRLGFTSQGTSDALKRAQRGAIFGLCKTIGLEWSESDVFSRGVDIAQGMHPEDAAVAIVREMACADIRIREVGIGANQQRCTIRAAKLETGNPQRQIAKDDVLLVSGGARGITPLCIREITRQIAGGKYILLGRSKVSASEPAWCAGITDEKAVQKAATQELKRAFSAGEGPKPTPRAVTKLVGSVLGAREVRSSIAAIEALGGKAIYSSCDVNSAADVAKAVRDAESQLGARVSGIVHASGVLRDRLIEKKLPDEFDAVFGTKVTGLENLLAAVDRANLKHMVLFSSLAGFHGNVGQSDYAMANEALNKMGLELAKDVSVKSICFGPWDGGMVTPQLKKQFQEMGVQIIPREGGADTVARIVLGSSPAEILVGNWRTPSKKVGSDTITLHRKISAKSNPFLEDHVIQGRRVLPMTLAIGSLAETCLGLFPGYSLWAIDDAQLFKGVTVDGDVNCEVTLTPSTAPSGRVNVQATLKTFSSGKLVPAYRAVIVLSNQGAPPANATMQPPSLDADPALQGSVYDGKTLFHGPAFRGIDDVLSCTKSQLVAKCSAVPGSDAARGEFATDTDAHDPFVNDLAFQAMLVWVRRTLGQAALPNSIQRIVQHRPVPQDKPFYITLRSNQSGGHSQHKHALQFHNEQGDLFIDVQASVIATDSLAF

SEQ ID NO: 2 - protein, 2059 aa, Artificial sequence
  SzPUFA OrfB v3 protein
MAARNVSAAHEMHDEKRIAVVGMAVQYAGCKTKDEFWEVLMNGKVESKVISDKRLGSNYRAEHYKAERSKYADTFCNETYGTLDENEIDNEHELLLNLAKQALAETSVKDSTRCGIVSGCLSFPMDNLQGELLNVYQNHVEKKLGARVFKDASHWSEREQSNKPEAGDRRIFMDPASFVAEELNLGALHYSVDAACATALYVLRLAQDHLVSGAADVMLCGATCLPEPFFILSGFSTFQAMPVGTGQNVSMPLHKDSQGLTPGEGGSIMVLKRLDDAIRDGDHIYGTLLGANVSNSGTGLPLKPLLPSEKKCLMDTYTRINVHPHKIQYVECHATGTPQGDRVEIDAVKACFEGKVPRFGTTKGNFGHTLVAAGFAGMCKVLLSMKHGIIPPTPGIDDETKMDPLVVSGEAIPWPETNGEPKRAGLSAFGFGGTNAHAVFEEHDPSNAACTGHDSISALSARCGGESNMRIAITGMDATFGALKGLDAFERAIYTGAHGAIPLPEKRWRFLGKDKDFLDLCGVKATPHGCYIEDVEVDFQRLRTPMTPEDMLLPQQLLAVTTIDRAILDSGMKKGGNVAVFVGLGTDLELYRHRARVALKERVRPEASKKLNDMMQYINDCGTSTSYTSYIGNLVATRVSSQWGFTGPSFTITEGNNSVYRCAELGKYLLETGEVDGVVVAGVDLCGSAENLYVKSRRFKVSTSDTPRASFDAAADGYFVGEGCGAFVLKRETSCTKDDRIYACMDAIVPGNVPSACLREALDQARVKPGDIEMLELSADSARHLKDPSVLPKELTAEEEIGGLQTILRDDDKLPRNVATGSVKATVGDTGYASGAASLIKAALCIYNRYLPSNGDDWDEPAPEAPWDSTLFACQTSRAWLKNPGERRYAAVSGVSETRSCYSVLLSEAEGHYERENRISLDEEAPKLIVLRADSHEEILGRLDKIRERFLQPTGAAPRESELKAQARRIFLELLGETLAQDAASSGSQKPLALSLVSTPSKLQREVELAAKGIPRCLKMRRDWSSPAGSRYAPEPLASDRVAFMYGEGRSPYYGITQDIHRIWPELHEVINEKTNRLWAEGDRWVMPRASFKSELESQQQEFDRNMIEMFRLGILTSIAFTNLARDVLNITPKAAFGLSLGEISMIFAFSKKNGLISDQLTKDLRESDVWNKALAVEFNALREAWGIPQSVPKDEFWQGYIVRGTKQDIEAAIAPDSKYVRLTIINDANTALISGKPDACKAAIARLGGNIPALPVTQGMCGHCPEVGPYTKDIAKIHANLEFPVVDGLDLWTTINQKRLVPRATGAKDEWAPSSFGEYAGQLYEKQANFPQIVETIYKQNYDVFVEVGPNNHRSTAVRTTLGPQRNHLAGAIDKQNEDAWTTIVKLVASLKAHLVPGVTISPLYHSKLVAEAEACYAALCKGEKPKKNKFVRKIQLNGRFNSKADPISSADLASFPPADPAIEAAISSRIMKPVAPKFYARLNIDEQDETRDPILNKDNAPSSSSSSSSSSSSSSSPSPAPSAPVQKKAAPAAETKAVASADALRSALLDLDSMLALSSASASGNLVETAPSDASVIVPPCNIADLGSRAFMKTYGVSAPLYTGAMAKGIASADLVIAAGRQGILASFGAGGLPMQVVRESIEKIQAALPNGPYAVNLIHSPFDSNLEKGNVDLFLEKGVTFVEASAFMTLTPQVVRYRAAGLTRNADGSVNIRNRIIGKVSRTELAEMFMRPAPEHLLQKLIASGEINQEQAELARRVPVADDIAVEADSGGHTDNRPIHVILPLIINLRDRLHRECGYPANLRVRVGAGGGIGCPQAALATFNMGASFIVTGTVNQVAKQSGTCDNVRKQLAKATYSDVCMAPAADMFEEGVKLQVLKKGTMFPSRANKLYELFCKYDSFESMPPAELARVEKRIFSRALEEVWDETKNFYINRLHNPEKIQRAERDPKLKMSLCFRWYLSLASRWANTGASDRVMDYQVWCGPAIGSFNDFIKGTYLDPAVANEYPCVVQINKQILRGACFLRRLEILRNARLSDGAAALVASIDDTYVPAEKL

SEQ ID NO: 3 - protein, 1493 aa, Artificial sequence
  hSzThPUFA OrfC v3 protein
MALRVKTNKKPCWEMTKEELTSGKTEVFNYEELLEFAEGDIAKVFGPEFAVIDKYPRRVRLPAREYLLVTRVTLMDAEVNNYRVGARMVTEYDLPVNGELSEGGDCPWAVLVESGQCDLMLISYMGIDFQNQGDRVYRLLNTTLTFYGVAHEGETLEYDIRVTGFAKRLDGGISMFFFEYDCYVNGRLLIEMRDGCAGFFTNEELDAGKGVVFTRGDLAARAKIPKQDVSPYAVAPCLHKTKLNEKEMQTLVDKDWASVFGSKNGMPEINYKLCARKMLMIDRVTSIDHKGGVYGLGQLVGEKILERDHWYFPCHFVKDQVMAGSLVSDGCSQMLKMYMIWLGLHLTTGPFDFRPVNGHPNKVRCRGQISPHKGKLVYVMEIKEMGFDEDNDPYAIADVNIIDVDFEKGQDFSLDRISDYGKGDLNKKIVVDFKGIALKMQKRSTNKNPSKVQPVFANGAATVGPEASKASSGASASASAAPAKPAFSADVLAPKPVALPEHILKGDALAPKEMSWHPMSKLPGNPTPFFSPSSYPPRAICFIPFPGNPLDNNCKAGEMPLNWYNMSEFMCGKVSNCLGPEFARFDKSNTSRSPAFDLALVTRVVEVTNMEHGKFLNVDCNPSKGTMVGEFDCPQDAWFFDGSCNDGHMPYSIIMEIGLQTSGVLTSVLKAPLTMDKDDILFRNLDASAEMVRPDVDVRGKTIRNVTKCTGYAMLGKMGIHRFTFELSVDGVVFYKGSTSFGWFTPEVFAQQAGLDNGKKTEPWCKTNNTSVRRVEIASAKGKEQLTEKLPDATNAQVLRRSEQCEYLDYLNIAPDSGLHGKGYAHGHKDVNPQDWFFSCHFWFDPVMPGSLGIESMFQLIEAFAVDQNIPGEYNVSNPTFAHAPGKTAWKYRGQLTPKNRAMDCEVHIVSITASPENGGYVDIVADGALWVDGLRVYEAKELRVRVVSAKPQAIPDVQQQPPSAKADPGKTGVALSPTQLRDVLLEVDNPLYLGVENSNLVQFESKPATSSRIVSIKPCSISDLGDKSFMETYNVSAPLYTGAMAKGIASADLVIAAGKRKILGSFGAGGLPMHHVRAALEKIQAALPQGPYAVNLIHSPFDSNLEKGNVDLFLEKGVTVVEASAFMTLTPQVVRYRAAGLSRNADGSVNIRNRIIGKVSRTELAEMFIRPAPEHLLEKLIASGEITQEQAELARRVPVADDIAVEADSGGHTDNRPIHVILPLIINLRNRLHRECGYPAHLRVRVGAGGGVGCPQAAAAALTMGAAFIVTGTVNQVAKQSGTCDNVRKQLSQATYSDICMAPAADMFEEGVKLQVLKKGTMFPSRANKLYELFCKYDSFDSMPPAELERIEKRIFKRALQEVWEETKDFYINGLKNPEKIQRAEHDPKLKMSLCFRWYLGLASRWANMGAPDRVMDYQVWCGPAIGAFNDFIKGTYLDPAVSNEYPCVVQINLQILRGACYLRRLNALRNDPRIDLETEDAAFVYEPTNAL

SEQ ID NO: 4 - protein, 780 aa, Artificial sequence
  SzACS-2 v3 protein
MPTPDATAPLNKPSDYAVYHEEDGPFWTADSSGVSRVNFSETGVGSEGVIPALTLIDVFERAVKRGGNRIAFRTENMPTLRRGEEAPDALPLKDWKSWSWKQYKADVHRIARALMDLGVEQHDAVSIFGFNSPEWFLSAVGAVHAGAKIAGIYPSDTPAQVQYKAFHSDTAVAVVENEQCFKKFAEVVEDLPYLKAIVCWDYEATDITREDGSVVEVLTFAEFLKRGDTVEAAALDERISKIEPTMCAALIYTSGTTGRPKAVMISHDNLVFEASAVVPNLGGACTTTAEERILSYLPLSHVAGMMVDIIAPIIATAFHKGRICVCFARPYDLRTGTLGQRLNAVEPTIFLGVPRVWEKIQEKLMAVGAKTTGLKKKLSTAAKKRGLEFQEEQQIGRSGANPGFGPLGIYKKLLGLIKGKLGLTKCKFAFAGAAPMTRETLQYFGALNININEVYGMSECSGAATWSTDKAHEWGTVGYEMPSCEVRVFKIAEDGTKTECPRAADIMHATEEEQGEVCFRGRNIMMGYLANPKLGDDHVAEIEEKNAAAIDSEGWLHSGDKGAISTRGMLKITGRYKELIIGAGGENVAPVPIEDAIKARMPFVSNAMMVGDKRKFMAVLLTLKTVGATGELPGTNKLMGAAADYGETIEDACDNEALIEEITQQLKEIGDDGDVTPSNAARIQKFTILPLDFSVSTDELTATLKLKRSVVADKYEDIIEAFYESKSVFVPYSTVGAYATGGPVDDSVVDGSFKGDFSMIGDDDPDLQNVDVLEAIDEDN

SEQ ID NO: 5 - protein, 237 aa, Artificial sequence
  NoHetI v3 protein
MLQHTWLPKPPNLTLLSDEVHLWRIPLDQPESQLQDLAATLSSDELARANRFYFPEHRRRFTAGRGILRSILGGYLGVEPGQVKFDYESRGKPILGDRFAESGLLFNLSHSQNLALCAVNYTRQIGIDLEYLRPTSDLESLAKRFFLPREYELLRSLPDEQKQKIFFRYWTCKEAYLKATGDGIAKLEEIEIALTPTEPAKLQTAPAWSLLELVPDDNCVAAVAVAGFGWQPKFWHY

SEQ ID NO: 6 - DNA, 8733 bp, Artificial sequence
  SzPUFA OrfA v3 gene
atggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctga

SEQ ID NO: 7 - DNA, 6180 bp, Artificial sequence
  SzPUFA OrfB v3 gene
atggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtga

SEQ ID NO: 8 - DNA, 4482 bp, Artificial sequence
  hSzThPUFA OrfC v3 gene
atggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttga

SEQ ID NO: 9 - DNA, 2343 bp, Artificial sequence
  SzACS-2 v3 gene
atgcccactccagatgccactgcgcctctcaacaagccgtcagactatgctgtgtaccacgaagaggatggtcctttctggactgctgattcctctggtgtcagcagagtgaacttctctgaaactggtgtgggatctgaaggtgtcattcctgcgctcacactgattgatgtgtttgagcgtgcggtcaaacgtggtggcaataggattgcattcagaacagagaacatgccaaccttgaggcgtggagaagaggctcctgatgctttgccgctcaaagattggaagtcctggtcttggaaacagtacaaagctgatgttcacagaattgcgagggctctgatggatttgggagttgagcagcacgatgcggtctccatctttggcttcaactcaccagaatggttcctcagtgctgtcggtgcagttcatgctggtgccaagatcgctggaatctacccttcagacactcctgctcaagtgcagtacaaagccttccactctgacactgctgttgcagttgtggagaacgaacagtgcttcaagaaattcgcagaggtggttgaggatctcccttacctcaaagccattgtttgttgggattatgaagccacagacatcacaagggaagatggttcagtggttgaagtcctgacctttgctgagttcctgaagagaggtgacactgtggaagcagctgcacttgatgagagaatcagcaagattgagcccaccatgtgtgctgccctgatctacaccagtggcacaactgggagacccaaagctgtcatgatctcccatgacaaccttgtctttgaagcatctgctgtggtcccgaacttgggaggggcatgcacgaccactgctgaggaaaggattctttcctaccttcctttgtctcatgttgctggaatgatggttgacatcattgctccaatcatagcgacagcgttccacaaaggaaggatctgtgtttgttttgccagaccgtatgatttgagaactggaacccttgggcaaagactcaatgcagtggagccaaccatattccttggtgtgccacgtgtgtgggaaaagatccaagagaaattgatggctgttggtgccaaaaccactggtctcaagaagaaactcagcacggcagccaagaaacgtgggcttgaatttcaagaggaacaacagatagggagaagtggtgccaaccctggctttggaccgcttggaatctacaagaaacttttgggcctcatcaaaggaaagttggggctgaccaaatgcaagtttgcctttgctggcgcagctccaatgacccgtgaaacccttcagtactttggagcgctgaacatcaacatcaatgaggtctatggaatgtctgaatgcagtggggctgccacctggtcaactgacaaagctcatgagtggggcactgttggctatgagatgccctcctgtgaagtcagagtgttcaagattgcggaggatggcaccaagacagagtgcccaagagctgctgacatcatgcatgccacagaagaggaacaaggtgaagtttgcttccgtggaaggaacatcatgatgggatacttggccaacccgaaacttggtgatgaccatgttgctgagattgaagagaagaatgcagctgccatagatagcgaagggtggcttcactctggtgacaagggagcaatttccacaaggggaatgctcaagataacgggcagatacaaggagcttatcataggtgctggtggggagaatgtggctcctgttcccattgaagatgccatcaaggcgaggatgccttttgtttcaaatgcaatgatggttggagacaagaggaagttcatggctgtccttctgactttgaaaacggttggagcaactggagagcttcctggcacaaacaagctcatgggagcagctgcggactatggtgagaccattgaggatgcctgtgacaatgaggcgctcattgaagagataacgcagcaactcaaagagataggtgacgatggagatgtcacgccaagcaatgcagcccgtatacaaaagttcacgattttgccactcgacttcagtgtctccacagatgaactgacagcaacgttgaaattgaagagaagtgtggttgcagacaagtatgaggacatcatagaggctttctatgagagcaagtctgtctttgtgccttactcaacagttggagcttatgcaacgggtggaccagttgatgactctgttgtggatggatcattcaaaggtgactttagcatgattggggatgacgatccggatcttcagaatgtggatgtccttgaagcaattgatgaggacaactga

SEQ ID NO: 10 - DNA, 714 bp, Artificial sequence
  NoHetI v3 gene
atgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactga

SEQ ID NO: 11 - DNA, 33003 bp, Artificial sequence
  pDAB7362 T-strand
cagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggcgagtcatgagtcgtgacatgacgtcatgctcatcagactgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcccactccagatgccactgcgcctctcaacaagccgtcagactatgctgtgtaccacgaagaggatggtcctttctggactgctgattcctctggtgtcagcagagtgaacttctctgaaactggtgtgggatctgaaggtgtcattcctgcgctcacactgattgatgtgtttgagcgtgcggtcaaacgtggtggcaataggattgcattcagaacagagaacatgccaaccttgaggcgtggagaagaggctcctgatgctttgccgctcaaagattggaagtcctggtcttggaaacagtacaaagctgatgttcacagaattgcgagggctctgatggatttgggagttgagcagcacgatgcggtctccatctttggcttcaactcaccagaatggttcctcagtgctgtcggtgcagttcatgctggtgccaagatcgctggaatctacccttcagacactcctgctcaagtgcagtacaaagccttccactctgacactgctgttgcagttgtggagaacgaacagtgcttcaagaaattcgcagaggtggttgaggatctcccttacctcaaagccattgtttgttgggattatgaagccacagacatcacaagggaagatggttcagtggttgaagtcctgacctttgctgagttcctgaagagaggtgacactgtggaagcagctgcacttgatgagagaatcagcaagattgagcccaccatgtgtgctgccctgatctacaccagtggcacaactgggagacccaaagctgtcatgatctcccatgacaaccttgtctttgaagcatctgctgtggtcccgaacttgggaggggcatgcacgaccactgctgaggaaaggattctttcctaccttcctttgtctcatgttgctggaatgatggttgacatcattgctccaatcatagcgacagcgttccacaaaggaaggatctgtgtttgttttgccagaccgtatgatttgagaactggaacccttgggcaaagactcaatgcagtggagccaaccatattccttggtgtgccacgtgtgtgggaaaagatccaagagaaattgatggctgttggtgccaaaaccactggtctcaagaagaaactcagcacggcagccaagaaacgtgggcttgaatttcaagaggaacaacagatagggagaagtggtgccaaccctggctttggaccgcttggaatctacaagaaacttttgggcctcatcaaaggaaagttggggctgaccaaatgcaagtttgcctttgctggcgcagctccaatgacccgtgaaacccttcagtactttggagcgctgaacatcaacatcaatgaggtctatggaatgtctgaatgcagtggggctgccacctggtcaactgacaaagctcatgagtggggcactgttggctatgagatgccctcctgtgaagtcagagtgttcaagattgcggaggatggcaccaagacagagtgcccaagagctgctgacatcatgcatgccacagaagaggaacaaggtgaagtttgcttccgtggaaggaacatcatgatgggatacttggccaacccgaaacttggtgatgaccatgttgctgagattgaagagaagaatgcagctgccatagatagcgaagggtggcttcactctggtgacaagggagcaatttccacaaggggaatgctcaagataacgggcagatacaaggagcttatcataggtgctggtggggagaatgtggctcctgttcccattgaagatgccatcaaggcgaggatgccttttgtttcaaatgcaatgatggttggagacaagaggaagttcatggctgtccttctgactttgaaaacggttggagcaactggagagcttcctggcacaaacaagctcatgggagcagctgcggactatggtgagaccattgaggatgcctgtgacaatgaggcgctcattgaagagataacgcagcaactcaaagagataggtgacgatggagatgtcacgccaagcaatgcagcccgtatacaaaagttcacgattttgccactcgacttcagtgtctccacagatgaactgacagcaacgttgaaattgaagagaagtgtggttgcagacaagtatgaggacatcatagaggctttctatgagagcaagtctgtctttgtgccttactcaacagttggagcttatgcaacgggtggaccagttgatgactctgttgtggatggatcattcaaaggtgactttagcatgattggggatgacgatccggatcttcagaatgtggatgtccttgaagcaattgatgaggacaactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgatcatggatgctacgtcacggcagtacaggactatcactagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttga

SEQ ID NO: 12 - DNA, 20 bp, Artificial sequence
  Sz ORFA v3 Forward Primer
cacaaccggtgttgatgatg

SEQ ID NO: 13 - DNA, 20 bp, Artificial sequence
  Sz ORFA v3 Reverse Primer
gagcttcacaaaggctctgc

SEQ ID NO: 14 - DNA, 20 bp, Artificial sequence
  Sz ORFB v3 Forward Primer
gaatccttgcgtcatttggt

SEQ ID NO: 15 - DNA, 20 bp, Artificial sequence
  Sz ORFB v3 Reverse Primer
caatggactcacgcacaact

SEQ ID NO: 16 - DNA, 22 bp, Artificial sequence
  hThSzORFCv3 Forward Primer
ggattacctcaacattgctcct

SEQ ID NO: 17 - DNA, 19 bp, Artificial sequence
  hThSzORFCv3 Reverse Primer
tgtccatgcgcatatcctt

SEQ ID NO: 18 - DNA, 21 bp, Artificial sequence
  SzACS2 v3 Forward Primer
agaaattgatggctgttggtg

SEQ ID NO: 19 - DNA, 19 bp, Artificial sequence
  SzACS2 v3 Reverse Primer
ctgccgtgctgagtttctt

SEQ ID NO: 20 - DNA, 20 bp, Artificial sequence
  NoHetI v3 Forward Primer
ccagaacacagaaggcgttt

SEQ ID NO: 21 - DNA, 21 bp, Artificial sequence
  NoHetI v3 Reverse Primer
tcccaagtatccacccaagat

SEQ ID NO: 22 - DNA, 29 bp, Artificial sequence
  PAT v5 Forward Primer
acaagagtggattgatgatctagagaggt

SEQ ID NO: 23 - DNA, 29 bp, Artificial sequence
  PAT v5 Reverse Primer
ctttgatgcctatgtgacacgtaaacagt

SEQ ID NO: 24 - DNA, 29 bp, Artificial sequence
  PAT v5 Probe
ccagcgtaagcaataccagccacaacacc

SEQ ID NO: 25 - DNA, 24 bp, Artificial sequence
  GMS116 Forward Primer
gtaatatgggctcagaggaatggt

SEQ ID NO: 26 - DNA, 23 bp, Artificial sequence
  GMS116 Reverse Primer
atggagaagaacattggaattgc

SEQ ID NO: 27 - DNA, 23 bp, Artificial sequence
  GMS116 Probe
ccatggcccggtaccatctggtc

SEQ ID NO: 28 - DNA, 240 bp, Arabidopsis thaliana
  Ribulose Bisphosphate Carboxylase small chain 1A
atggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaa

SEQ ID NO: 29 - DNA, 105 bp, Artificial sequence
  Acyl-ACP Thioesterase Transit Peptide
atgcttaagctctcttgtaacgttaccaatcatcttcacacattctcattctttagcgattctagtctgttcatccctgtcaacagaaggactcttgctgtgtct

SEQ ID NO: 30 - DNA, 2346 bp, Artificial sequence
  SzACS-2 v4 gene
atggctcccactcccgacgccaccgcgcctctgaacaagccgagcgactatgccgtctaccacgaggaagacggccccttctggaccgccgattccagcggcgtctcgcgcgtgaactttagcgagaccggcgtgggatccgagggcgtcatccctgcgctcacgctcatcgacgtcttcgagagggccgtcaagcgcggcggaaacaggatcgccttccgcacggaaaacatgcccacgctccgccgcggcgaagaggccccggacgcgctgccgctcaaggactggaagtcctggtcctggaaacagtacaaggccgacgtccaccgcatcgccagggctctcatggacctcggcgttgagcagcacgacgccgtctcgatttttggctttaactcgcccgaatggtttctcagtgccgtcggcgccgtgcacgcaggtgccaagattgccggtatttacccctcagacacgcccgcccaggtccagtacaaggccttccacagtgacaccgctgttgccgttgtcgaaaacgagcagtgcttcaagaagttcgccgaggtcgtcgaggaccttccttacctcaaggccattgtttgctgggactatgaagccacagacatcacgcgcgaggacggctccgtcgtcgaggtcctcacctttgccgagttcctcaagcgcggcgacaccgtcgaggcggccgcccttgacgagcgcatctccaagatcgagcccaccatgtgcgctgcccttatttacaccagcggtactaccggccgccccaaggccgttatgatttcgcacgacaaccttgttttcgaggccagcgccgtcgtccccaacctcggaggagcctgtacgaccactgctgaggagcgcattctctcgtacctgcctctctcgcacgtcgctggtatgatggttgatattattgcccccatcattgccaccgccttccacaagggccgcatctgcgtctgctttgctcgcccgtacgatttgcgcaccggcacgctgggccagcgcctcaacgccgtggagcccaccatcttccttggcgtgccccgtgtgtgggaaaagattcaggaaaagctcatggccgtcggtgccaaaaccaccggcctcaagaagaagctctctacggccgccaagaagcgtggtcttgaattccaggaggagcagcaaatcggccgctccggtgccaaccctggctttggcccccttggcatctacaagaagctcctcggcctcatcaagggcaagctgggcctcaccaagtgcaagtttgcctttgctggtgccgcgcccatgacccgtgagacccttcagtactttggcgcgctgaacatcaacattaacgaggtctacggcatgtcagagtgctccggtgccgccacctggtccacggacaaggcccacgagtggggcactgttggctacgagatgcccagttgcgaggtccgcgtcttcaagattgccgaggacggtaccaagaccgagtgcccgcgcgccgccgacattatgcatgctaccgaggaggagcagggcgaagtttgcttccgcggccgtaacatcatgatgggctaccttgccaaccccaagcttggcgacgaccacgttgccgagatcgaggagaagaacgctgccgctatcgactccgagggctggctccacagtggtgataagggcgccatttctacccgcggcatgctcaagatcacgggccgctacaaggagctcatcatcggcgccggtggcgagaacgtggcgcccgtccctattgaggacgccatcaaggcgcgcatgccttttgtttccaacgccatgatggtcggagataagcgcaagttcatggctgtcctccttaccctcaagacggttggcgccacgggcgagcttcccggtacgaacaagctcatgggcgctgccgccgactacggtgagaccatcgaggacgcctgcgacaacgaggcgctcattgaggagatcacgcagcagctcaaggagatcggtgatgatggcgatgtcacgccctcgaacgcggctcgcatccaaaagttcaccattctcccgctcgacttttccgtctccacggacgagctcacggccacgctcaagctcaagcgctccgtggtcgcagacaagtacgaagacatcatcgaggccttttacgagtccaagagcgtttttgtgccgtactcgaccgttggcgcctacgccacgggcggcccggtcgacgactccgttgtcgatggctcattcaagggcgactttagcatgattggcgacgatgatccggatcttcaaaacgtcgatgtcctcgaggcgattgacgaggacaattaa

SEQ ID NO: 31 - DNA, 38794 bp, Artificial sequence
  plasmid pDAB7361
gtacaaaaaagcaggcttctagacctagctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcggcccgtctgcaggagcaaaagggaggcgagatggatacccgcattgccatcatcggcatgtcggccatcctcccctgcggcacgaccgtgcgcgagtcgtgggagaccatccgcgccggcatcgactgcctgtcggatctccccgaggaccgcgtcgacgtgacggcgtactttgaccccgtcaagaccaccaaggacaagatctactgcaagcgcggtggcttcattcccgagtacgactttgacgcccgcgagttcggactcaacatgttccagatggaggactcggacgcaaaccagaccatctcgcttctcaaggtcaaggaggccctccaggacgccggcatcgacgccctcggcaaggaaaagaagaacatcggctgcgtgctcggcattggcggcggccaaaagtccagccacgagttctactcgcgccttaattatgttgtcgtggagaaggtcctccgcaagatgggcatgcccgaggaggacgtcaaggtcgccgtcgaaaagtacaaggccaacttccccgagtggcgcctcgactccttccctggcttcctcggcaacgtcaccgccggtcgctgcaccaacaccttcaacctcgacggcatgaactgcgttgtcgacgccgcatgcgcctcgtccctcatcgccgtcaaggtcgccatcgacgagctgctctacggtgactgcgacatgatggtcaccggtgccacctgcacggataactccatcggcatgtacatggccttctccaagacccccgtgttctccacggaccccagcgtgcgcgcctacgacgaaaagacaaagggcatgctcatcggcgagggctccgccatgctcgtcctcaagcgctacgccgacgccgtccgcgacggcgatgagatccacgctgttattcgcggctgcgcctcctccagtgatggcaaggccgccggcatctacacgcccaccatttcgggccaggaggaggccctccgccgcgcctacaaccgcgcctgtgtcgacccggccaccgtcactctcgtcgagggtcacggcaccggtactcccgttggcgaccgcatcgagctcaccgccttgcgcaacctctttgacaaggcctacggcgagggcaacaccgaaaaggtcgctgtgggcagcatcaagtccagcatcggccatctcaaggccgtcgccggtctcgccggtatgatcaaggtcatcatggcgctcaagcacaagactctcccgggcaccatcaacgtcgacaacccacccaacctctacgacaacacgcccatcaacgagtcctcgctctacattaacaccatgaaccgcccctggttcccgccccctggtgtgccccgccgcgccggcatttcgagctttggctttggtggcgccaactaccacgccgtcctcgaggaggccgagcccgagcacacgaccgcgtaccgcctcaacaagcgcccgcagcccgtgctcatgatggccgccacgcccgcggccctccagtcgctctgcgaggcccagctcaaggagttcgaggccgccatcaaggagaacgagaccgtcaagaacaccgcctacatcaagtgcgtcaagttcggcgagcagttcaaattccctggctccatcccggccacaaacgcgcgcctcggcttcctcgtcaaggatgctgaggatgcctgctccaccctccgtgccatctgcgcccaattcgccaaggatgtcaccaaggaggcctggcgcctcccccgcgagggcgtcagcttccgcgccaagggcatcgccaccaacggcgctgtcgccgcgctcttctccggccagggcgcgcagtacacgcacatgtttagcgaggtggccatgaactggccccagttccgccagagcattgccgccatggacgccgcccagtccaaggtcgctggaagcgacaaggactttgagcgcgtctcccaggtcctctacccgcgcaagccgtacgagcgtgagcccgagcaggaccacaagaagatctccctcaccgcctactcgcagccctcgaccctggcctgcgctctcggtgcctttgagatcttcaaggaggccggcttcaccccggactttgccgccggccattcgctcggtgagttcgccgccctctacgccgcgggctgcgtcgaccgcgacgagctctttgagcttgtctgccgccgcgcccgcatcatgggcggcaaggacgcaccggccacccccaagggctgcatggccgccgtcattggccccaacgccgagaacatcaaggtccaggccgccaacgtctggctcggcaactccaactcgccttcgcagaccgtcatcaccggctccgtcgaaggtatccaggccgagagcgcccgcctccagaaggagggcttccgcgtcgtgcctcttgcctgcgagagcgccttccactcgccccagatggagaacgcctcgtcggccttcaaggacgtcatctccaaggtctccttccgcacccccaaggccgagaccaagctcttcagcaacgtctctggcgagacctaccccacggacgcccgcgagatgcttacgcagcacatgaccagcagcgtcaagttcctcacccaggtccgcaacatgcaccaggccggtgcgcgcatctttgtcgagttcggacccaagcaggtgctctccaagcttgtctccgagaccctcaaggatgacccctcggttgtcaccgtctctgtcaacccggcctcgggcacggattcggacatccagctccgcgacgcggccgtccagctcgttgtcgctggcgtcaaccttcagggctttgacaagtgggacgcccccgatgccacccgcatgcaggccatcaagaagaagcgcactaccctccgcctttcggccgccacctacgtctcggacaagaccaagaaggtccgcgacgccgccatgaacgatggccgctgcgtcacctacctcaagggcgccgcaccgctcatcaaggccccggagcccgttgtcgacgaggccgccaagcgcgaggccgagcgtctccagaaggagcttcaggatgcccagcgccagctcgacgacgccaagcgcgccgccgccgaggccaactccaagctcgccgctgccaaggaggaggccaagaccgccgctgcttcggccaagcccgcagttgacactgctgttgtcgaaaagcatcgtgccatcctcaagtccatgctcgcggagctcgatggctacggatcggtcgacgcttcttccctccagcagcagcagcagcagcagacggcccccgccccggtcaaggctgctgcgcctgccgcccccgttgcctcggcccctgccccggctgtctcgaacgagcttcttgagaaggccgagactgtcgtcatggaggtcctcgccgccaagaccggctacgagaccgacatgatcgaggctgacatggagctcgagaccgagctcggcattgactccatcaagcgtgtcgagatcctctccgaggtccaggccatgctcaatgtcgaggccaaggatgtcgatgccctcagccgcactcgcactgttggtgaggttgtcaacgccatgaaggccgagatcgctggcagctctgccccggcgcctgctgccgctgctccggctccggccaaggctgcccctgccgccgctgcgcctgctgtctcgaacgagcttctcgagaaggccgagaccgtcgtcatggaggtcctcgccgccaagactggctacgagactgacatgatcgagtccgacatggagctcgagactgagctcggcattgactccatcaagcgtgtcgagatcctctccgaggttcaggccatgctcaacgtcgaggccaaggacgtcgacgctctcagccgcactcgcactgtgggtgaggtcgtcaacgccatgaaggctgagatcgctggtggctctgccccggcgcctgccgccgctgccccaggtccggctgctgccgcccctgcgcctgccgccgccgcccctgctgtctcgaacgagcttcttgagaaggccgagaccgtcgtcatggaggtcctcgccgccaagactggctacgagactgacatgatcgagtccgacatggagctcgagaccgagctcggcattgactccatcaagcgtgtcgagattctctccgaggtccaggccatgctcaacgtcgaggccaaggacgtcgacgctctcagccgcacccgcactgttggcgaggtcgtcgatgccatgaaggccgagatcgctggtggctctgccccggcgcctgccgccgctgctcctgctccggctgctgccgcccctgcgcctgccgcccctgcgcctgctgtctcgagcgagcttctcgagaaggccgagactgtcgtcatggaggtcctcgccgccaagactggctacgagactgacatgatcgagtccgacatggagctcgagaccgagctcggcattgactccatcaagcgtgtcgagattctctccgaggtccaggccatgctcaacgtcgaggccaaggacgtcgacgctctcagccgcacccgcactgttggcgaggtcgtcgatgccatgaaggccgagatcgctggtggctctgccccggcgcctgccgccgctgctcctgctccggctgctgccgcccctgcgcctgccgcccctgcgcctgccgcccctgcgcctgctgtctcgagcgagcttctcgagaaggccgagactgtcgtcatggaggtcctcgccgccaagactggctacgagactgacatgattgagtccgacatggagctcgagaccgagctcggcattgactccatcaagcgtgtcgagattctctccgaggttcaggccatgctcaacgtcgaggccaaggacgtcgacgctctcagccgcactcgcactgttggtgaggtcgtcgatgccatgaaggctgagatcgctggcagctccgcctcggcgcctgccgccgctgctcctgctccggctgctgccgctcctgcgcccgctgccgccgcccctgctgtctcgaacgagcttctcgagaaagccgagactgtcgtcatggaggtcctcgccgccaagactggctacgagactgacatgatcgagtccgacatggagctcgagactgagctcggcattgactccatcaagcgtgtcgagatcctctccgaggttcaggccatgctcaacgtcgaggccaaggacgtcgatgccctcagccgcacccgcactgttggcgaggttgtcgatgccatgaaggccgagatcgctggtggctctgccccggcgcctgccgccgctgcccctgctccggctgccgccgcccctgctgtctcgaacgagcttctcgagaaggccgagactgtcgtcatggaggtcctcgccgccaagactggctacgagaccgacatgatcgagtccgacatggagctcgagaccgagctcggcattgactccatcaagcgtgtcgagattctctccgaggttcaggccatgctcaacgtcgaggccaaggacgtcgatgctctcagccgcactcgcactgttggcgaggtcgtcgatgccatgaaggctgagatcgccggcagctccgccccggcgcctgccgccgctgctcctgctccggctgctgccgctcctgcgcccgctgccgctgcccctgctgtctcgagcgagcttctcgagaaggccgagaccgtcgtcatggaggtcctcgccgccaagactggctacgagactgacatgattgagtccgacatggagctcgagactgagctcggcattgactccatcaagcgtgtcgagatcctctccgaggttcaggccatgctcaacgtcgaggccaaggacgtcgatgccctcagccgcacccgcactgttggcgaggttgtcgatgccatgaaggccgagatcgctggtggctctgccccggcgcctgccgccgctgcccctgctccggctgccgccgcccctgctgtctcgaacgagcttcttgagaaggccgagaccgtcgtcatggaggtcctcgccgccaagactggctacgagaccgacatgatcgagtccgacatggagctcgagaccgagctcggcattgactccatcaagcgtgtcgagattctctccgaggttcaggccatgctcaacgtcgaggccaaggacgtcgacgctctcagccgcactcgcactgttggcgaggtcgtcgatgccatgaaggctgagatcgctggtggctctgccccggcgcctgccgccgctgctcctgcctcggctggcgccgcgcctgcggtcaagattgactcggtccacggcgctgactgtgatgatctttccctgatgcacgccaaggtggttgacatccgccgcccggacgagctcatcctggagcgccccgagaaccgccccgttctcgttgtcgatgacggcagcgagctcaccctcgccctggtccgcgtcctcggcgcctgcgccgttgtcctgacctttgagggtctccagctcgctcagcgcgctggtgccgctgccatccgccacgtgctcgccaaggatctttccgcggagagcgccgagaaggccatcaaggaggccgagcagcgctttggcgctctcggcggcttcatctcgcagcaggcggagcgcttcgagcccgccgaaatcctcggcttcacgctcatgtgcgccaagttcgccaaggcttccctctgcacggctgtggctggcggccgcccggcctttatcggtgtggcgcgccttgacggccgcctcggattcacttcgcagggcacttctgacgcgctcaagcgtgcccagcgtggtgccatctttggcctctgcaagaccatcggcctcgagtggtccgagtctgacgtcttttcccgcggcgtggacattgctcagggcatgcaccccgaggatgccgccgtggcgattgtgcgcgagatggcgtgcgctgacattcgcattcgcgaggtcggcattggcgcaaaccagcagcgctgcacgatccgtgccgccaagctcgagaccggcaacccgcagcgccagatcgccaaggacgacgtgctgctcgtttctggcggcgctcgcggcatcacgcctctttgcatccgggagatcacgcgccagatcgcgggcggcaagtacattctgcttggccgcagcaaggtctctgcgagcgaaccggcatggtgcgctggcatcactgacgagaaggctgtgcaaaaggctgctacccaggagctcaagcgcgcctttagcgctggcgagggccccaagcccacgccccgcgctgtcactaagcttgtgggctctgttcttggcgctcgcgaggtgcgcagctctattgctgcgattgaagcgctcggcggcaaggccatctactcgtcgtgcgacgtgaactctgccgccgacgtggccaaggccgtgcgcgatgccgagtcccagctcggtgcccgcgtctcgggcatcgttcatgcctcgggcgtgctccgcgaccgtctcatcgagaagaagctccccgacgagttcgacgccgtctttggcaccaaggtcaccggtctcgagaacctcctcgccgccgtcgaccgcgccaacctcaagcacatggtcctcttcagctcgctcgccggcttccacggcaacgtcggccagtctgactacgccatggccaacgaggcccttaacaagatgggcctcgagctcgccaaggacgtctcggtcaagtcgatctgcttcggtccctgggacggtggcatggtgacgccgcagctcaagaagcagttccaggagatgggcgtgcagatcatcccccgcgagggcggcgctgataccgtggcgcgcatcgtgctcggctcctcgccggctgagatccttgtcggcaactggcgcaccccgtccaagaaggtcggctcggacaccatcaccctgcaccgcaagatttccgccaagtccaaccccttcctcgaggaccacgtcatccagggccgccgcgtgctgcccatgacgctggccattggctcgctcgcggagacctgcctcggcctcttccccggctactcgctctgggccattgacgacgcccagctcttcaagggtgtcactgtcgacggcgacgtcaactgcgaggtgaccctcaccccgtcgacggcgccctcgggccgcgtcaacgtccaggccacgctcaagaccttttccagcggcaagctggtcccggcctaccgcgccgtcatcgtgctctccaaccagggcgcgcccccggccaacgccaccatgcagccgccctcgctcgatgccgatccggcgctccagggctccgtctacgacggcaagaccctcttccacggcccggccttccgcggcatcgatgacgtgctctcgtgcaccaagagccagcttgtggccaagtgcagcgctgtccccggctccgacgccgctcgcggcgagtttgccacggacactgacgcccatgaccccttcgtgaacgacctggcctttcaggccatgctcgtctgggtgcgccgcacgctcggccaggctgcgctccccaactcgatccagcgcatcgtccagcaccgcccggtcccgcaggacaagcccttctacattaccctccgctccaaccagtcgggcggtcactcccagcacaagcacgcccttcagttccacaacgagcagggcgatctcttcattgatgtccaggcttcggtcatcgccacggacagccttgccttctaaatctaaactaggccatggtgacttaaggtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggcgagtcatgagtcgtgacatgacgtcatgctcatcagactgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcccactccagatgccactgcgcctctcaacaagccgtcagactatgctgtgtaccacgaagaggatggtcctttctggactgctgattcctctggtgtcagcagagtgaacttctctgaaactggtgtgggatctgaaggtgtcattcctgcgctcacactgattgatgtgtttgagcgtgcggtcaaacgtggtggcaataggattgcattcagaacagagaacatgccaaccttgaggcgtggagaagaggctcctgatgctttgccgctcaaagattggaagtcctggtcttggaaacagtacaaagctgatgttcacagaattgcgagggctctgatggatttgggagttgagcagcacgatgcggtctccatctttggcttcaactcaccagaatggttcctcagtgctgtcggtgcagttcatgctggtgccaagatcgctggaatctacccttcagacactcctgctcaagtgcagtacaaagccttccactctgacactgctgttgcagttgtggagaacgaacagtgcttcaagaaattcgcagaggtggttgaggatctcccttacctcaaagccattgtttgttgggattatgaagccacagacatcacaagggaagatggttcagtggttgaagtcctgacctttgctgagttcctgaagagaggtgacactgtggaagcagctgcacttgatgagagaatcagcaagattgagcccaccatgtgtgctgccctgatctacaccagtggcacaactgggagacccaaagctgtcatgatctcccatgacaaccttgtctttgaagcatctgctgtggtcccgaacttgggaggggcatgcacgaccactgctgaggaaaggattctttcctaccttcctttgtctcatgttgctggaatgatggttgacatcattgctccaatcatagcgacagcgttccacaaaggaaggatctgtgtttgttttgccagaccgtatgatttgagaactggaacccttgggcaaagactcaatgcagtggagccaaccatattccttggtgtgccacgtgtgtgggaaaagatccaagagaaattgatggctgttggtgccaaaaccactggtctcaagaagaaactcagcacggcagccaagaaacgtgggcttgaatttcaagaggaacaacagatagggagaagtggtgccaaccctggctttggaccgcttggaatctacaagaaacttttgggcctcatcaaaggaaagttggggctgaccaaatgcaagtttgcctttgctggcgcagctccaatgacccgtgaaacccttcagtactttggagcgctgaacatcaacatcaatgaggtctatggaatgtctgaatgcagtggggctgccacctggtcaactgacaaagctcatgagtggggcactgttggctatgagatgccctcctgtgaagtcagagtgttcaagattgcggaggatggcaccaagacagagtgcccaagagctgctgacatcatgcatgccacagaagaggaacaaggtgaagtttgcttccgtggaaggaacatcatgatgggatacttggccaacccgaaacttggtgatgaccatgttgctgagattgaagagaagaatgcagctgccatagatagcgaagggtggcttcactctggtgacaagggagcaatttccacaaggggaatgctcaagataacgggcagatacaaggagcttatcataggtgctggtggggagaatgtggctcctgttcccattgaagatgccatcaaggcgaggatgccttttgtttcaaatgcaatgatggttggagacaagaggaagttcatggctgtccttctgactttgaaaacggttggagcaactggagagcttcctggcacaaacaagctcatgggagcagctgcggactatggtgagaccattgaggatgcctgtgacaatgaggcgctcattgaagagataacgcagcaactcaaagagataggtgacgatggagatgtcacgccaagcaatgcagcccgtatacaaaagttcacgattttgccactcgacttcagtgtctccacagatgaactgacagcaacgttgaaattgaagagaagtgtggttgcagacaagtatgaggacatcatagaggctttctatgagagcaagtctgtctttgtgccttactcaacagttggagcttatgcaacgggtggaccagttgatgactctgttgtggatggatcattcaaaggtgactttagcatgattggggatgacgatccggatcttcagaatgtggatgtccttgaagcaattgatgaggacaactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgatcatggatgctacgtcacggcagtacaggactatcactagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagttt

SEQ ID NO: 32 - DNA, 39711 bp, Artificial sequence
  plasmid pDAB7363
gtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaagcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaagctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaagcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggcgagtcatgagtcgtgacatgacgtcatgctcatcagactgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcccactccagatgccactgcgcctctcaacaagccgtcagactatgctgtgtaccacgaagaggatggtcctttctggactgctgattcctctggtgtcagcagagtgaacttctctgaaactggtgtgggatctgaaggtgtcattcctgcgctcacactgattgatgtgtttgagcgtgcggtcaaacgtggtggcaataggattgcattcagaacagagaacatgccaaccttgaggcgtggagaagaggctcctgatgctttgccgctcaaagattggaagtcctggtcttggaaacagtacaaagctgatgttcacagaattgcgagggctctgatggatttgggagttgagcagcacgatgcggtctccatctttggcttcaactcaccagaatggttcctcagtgctgtcggtgcagttcatgctggtgccaagatcgctggaatctacccttcagacactcctgctcaagtgcagtacaaagccttccactctgacactgctgttgcagttgtggagaacgaacagtgcttcaagaaattcgcagaggtggttgaggatctcccttacctcaaagccattgtttgttgggattatgaagccacagacatcacaagggaagatggttcagtggttgaagtcctgacctttgctgagttcctgaagagaggtgacactgtggaagcagctgcacttgatgagagaatcagcaagattgagcccaccatgtgtgctgccctgatctacaccagtggcacaactgggagacccaaagctgtcatgatctcccatgacaaccttgtctttgaagcatctgctgtggtcccgaacttgggaggggcatgcacgaccactgctgaggaaaggattctttcctaccttcctttgtctcatgttgctggaatgatggttgacatcattgctccaatcatagcgacagcgttccacaaaggaaggatctgtgtttgttttgccagaccgtatgatttgagaactggaacccttgggcaaagactcaatgcagtggagccaaccatattccttggtgtgccacgtgtgtgggaaaagatccaagagaaattgatggctgttggtgccaaaaccactggtctcaagaagaaactcagcacggcagccaagaaacgtgggcttgaatttcaagaggaacaacagatagggagaagtggtgccaaccctggctttggaccgcttggaatctacaagaaacttttgggcctcatcaaaggaaagttggggctgaccaaatgcaagtttgcctttgctggcgcagctccaatgacccgtgaaacccttcagtactttggagcgctgaacatcaacatcaatgaggtctatggaatgtctgaatgcagtggggctgccacctggtcaactgacaaagctcatgagtggggcactgttggctatgagatgccctcctgtgaagtcagagtgttcaagattgcggaggatggcaccaagacagagtgcccaagagctgctgacatcatgcatgccacagaagaggaacaaggtgaagtttgcttccgtggaaggaacatcatgatgggatacttggccaacccgaaacttggtgatgaccatgttgctgagattgaagagaagaatgcagctgccatagatagcgaagggtggcttcactctggtgacaagggagcaatttccacaaggggaatgctcaagataacgggcagatacaaggagcttatcataggtgctggtggggagaatgtggctcctgttcccattgaagatgccatcaaggcgaggatgccttttgtttcaaatgcaatgatggttggagacaagaggaagttcatggctgtccttctgactttgaaaacggttggagcaactggagagcttcctggcacaaacaagctcatgggagcagctgcggactatggtgagaccattgaggatgcctgtgacaatgaggcgctcattgaagagataacgcagcaactcaaagagataggtgacgatggagatgtcacgccaagcaatgcagcccgtatacaaaagttcacgattttgccactcgacttcagtgtctccacagatgaactgacagcaacgttgaaattgaagagaagtgtggttgcagacaagtatgaggacatcatagaggctttctatgagagcaagtctgtctttgtgccttactcaacagttggagcttatgcaacgggtggaccagttgatgactctgttgtggatggatcattcaaaggtgactttagcatgattggggatgacgatccggatcttcagaatgtggatgtccttgaagcaattgatgaggacaactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgatcatggatgctacgtcacggcagtacaggactatcactagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaacttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagttt

SEQ ID NO: 33 - DNA, 38811 bp, Artificial sequence
  plasmid pDAB7365
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctagctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcggcccgtctgcaggagcaaaagggaggcgagatggatacccgcattgccatcatcggcatgtcggccatcctcccctgcggcacgaccgtgcgcgagtcgtgggagaccatccgcgccggcatcgactgcctgtcggatctccccgaggaccgcgtcgacgtgacggcgtactttgaccccgtcaagaccaccaaggacaagatctactgcaagcgcggtggcttcattcccgagtacgactttgacgcccgcgagttcggactcaacatgttccagatggaggactcggacgcaaaccagaccatctcgcttctcaaggtcaaggaggccctccaggacgccggcatcgacgccctcggcaaggaaaagaagaacatcggctgcgtgctcggcattggcggcggccaaaagtccagccacgagttctactcgcgccttaattatgttgtcgtggagaaggtcctccgcaagatgggcatgcccgaggaggacgtcaaggtcgccgtcgaaaagtacaaggccaacttccccgagtggcgcctcgactccttccctggcttcctcggcaacgtcaccgccggtcgctgcaccaacaccttcaacctcgacggcatgaactgcgttgtcgacgccgcatgcgcctcgtccctcatcgccgtcaaggtcgccatcgacgagctgctctacggtgactgcgacatgatggtcaccggtgccacctgcacggataactccatcggcatgtacatggccttctccaagacccccgtgttctccacggaccccagcgtgcgcgcctacgacgaaaagacaaagggcatgctcatcggcgagggctccgccatgctcgtcctcaagcgctacgccgacgccgtccgcgacggcgatgagatccacgctgttattcgcggctgcgcctcctccagtgatggcaaggccgccggcatctacacgcccaccatttcgggccaggaggaggccctccgccgcgcctacaaccgcgcctgtgtcgacccggccaccgtcactctcgtcgagggtcacggcaccggtactcccgttggcgaccgcatcgagctcaccgccttgcgcaacctctttgacaaggcctacggcgagggcaacaccgaaaaggtcgctgtgggcagcatcaagtccagcatcggccatctcaaggccgtcgccggtctcgccggtatgatcaaggtcatcatggcgctcaagcacaagactctcccgggcaccatcaacgtcgacaacccacccaacctctacgacaacacgcccatcaacgagtcctcgctctacattaacaccatgaaccgcccctggttcccgccccctggtgtgccccgccgcgccggcatttcgagctttggctttggtggcgccaactaccacgccgtcctcgaggaggccgagcccgagcacacgaccgcgtaccgcctcaacaagcgcccgcagcccgtgctcatgatggccgccacgcccgcggccctccagtcgctctgcgaggcccagctcaaggagttcgaggccgccatcaaggagaacgagaccgtcaagaacaccgcctacatcaagtgcgtcaagttcggcgagcagttcaaattccctggctccatcccggccacaaacgcgcgcctcggcttcctcgtcaaggatgctgaggatgcctgctccaccctccgtgccatctgcgcccaattcgccaaggatgtcaccaaggaggcctggcgcctcccccgcgagggcgtcagcttccgcgccaagggcatcgccaccaacggcgctgtcgccgcgctcttctccggccagggcgcgcagtacacgcacatgtttagcgaggtggccatgaactggccccagttccgccagagcattgccgccatggacgccgcccagtccaaggtcgctggaagcgacaaggactttgagcgcgtctcccaggtcctctacccgcgcaagccgtacgagcgtgagcccgagcaggaccacaagaagatctccctcaccgcctactcgcagccctcgaccctggcctgcgctctcggtgcctttgagatcttcaaggaggccggcttcaccccggactttgccgccggccattcgctcggtgagttcgccgccctctacgccgcgggctgcgtcgaccgcgacgagctctttgagcttgtctgccgccgcgcccgcatcatgggcggcaaggacgcaccggccacccccaagggctgcatggccgccgtcattggccccaacgccgagaacatcaaggtccaggccgccaacgtctggctcggcaactccaactcgccttcgcagaccgtcatcaccggctccgtcgaaggtatccaggccgagagcgcccgcctccagaaggagggcttccgcgtcgtgcctcttgcctgcgagagcgccttccactcgccccagatggagaacgcctcgtcggccttcaaggacgtcatctccaaggtctccttccgcacccccaaggccgagaccaagctcttcagcaacgtctctggcgagacctaccccacggacgcccgcgagatgcttacgcagcacatgaccagcagcgtcaagttcctcacccaggtccgcaacatgcaccaggccggtgcgcgcatctttgtcgagttcggacccaagcaggtgctctccaagcttgtctccgagaccctcaaggatgacccctcggttgtcaccgtctctgtcaacccggcctcgggcacggattcggacatccagctccgcgacgcggccgtccagctcgttgtcgctggcgtcaaccttcagggctttgacaagtgggacgcccccgatgccacccgcatgcaggccatcaagaagaagcgcactaccctccgcctttcggccgccacctacgtctcggacaagaccaagaaggtccgcgacgccgccatgaacgatggccgctgcgtcacctacctcaagggcgccgcaccgctcatcaaggccccggagcccgttgtcgacgaggccgccaagcgcgaggccgagcgtctccagaaggagcttcaggatgcccagcgccagctcgacgacgccaagcgcgccgccgccgaggccaactccaagctcgccgctgccaaggaggaggccaagaccgccgctgcttcggccaagcccgcagttgacactgctgttgtcgaaaagcatcgtgccatcctcaagtccatgctcgcggagctcgatggctacggatcggtcgacgcttcttccctccagcagcagcagcagcagcagacggcccccgccccggtcaaggctgctgcgcctgccgcccccgttgcctcggcccctgccccggctgtctcgaacgagcttcttgagaaggccgagactgtcgtcatggaggtcctcgccgccaagaccggctacgagaccgacatgatcgaggctgacatggagctcgagaccgagctcggcattgactccatcaagcgtgtcgagatcctctccgaggtccaggccatgctcaatgtcgaggccaaggatgtcgatgccctcagccgcactcgcactgttggtgaggttgtcaacgccatgaaggccgagatcgctggcagctctgccccggcgcctgctgccgctgctccggctccggccaaggctgcccctgccgccgctgcgcctgctgtctcgaacgagcttctcgagaaggccgagaccgtcgtcatggaggtcctcgccgccaagactggctacgagactgacatgatcgagtccgacatggagctcgagactgagctcggcattgactccatcaagcgtgtcgagatcctctccgaggttcaggccatgctcaacgtcgaggccaaggacgtcgacgctctcagccgcactcgcactgtgggtgaggtcgtcaacgccatgaaggctgagatcgctggtggctctgccccggcgcctgccgccgctgccccaggtccggctgctgccgcccctgcgcctgccgccgccgcccctgctgtctcgaacgagcttcttgagaaggccgagaccgtcgtcatggaggtcctcgccgccaagactggctacgagactgacatgatcgagtccgacatggagctcgagaccgagctcggcattgactccatcaagcgtgtcgagattctctccgaggtccaggccatgctcaacgtcgaggccaaggacgtcgacgctctcagccgcacccgcactgttggcgaggtcgtcgatgccatgaaggccgagatcgctggtggctctgccccggcgcctgccgccgctgctcctgctccggctgctgccgcccctgcgcctgccgcccctgcgcctgctgtctcgagcgagcttctcgagaaggccgagactgtcgtcatggaggtcctcgccgccaagactggctacgagactgacatgatcgagtccgacatggagctcgagaccgagctcggcattgactccatcaagcgtgtcgagattctctccgaggtccaggccatgctcaacgtcgaggccaaggacgtcgacgctctcagccgcacccgcactgttggcgaggtcgtcgatgccatgaaggccgagatcgctggtggctctgccccggcgcctgccgccgctgctcctgctccggctgctgccgcccctgcgcctgccgcccctgcgcctgccgcccctgcgcctgctgtctcgagcgagcttctcgagaaggccgagactgtcgtcatggaggtcctcgccgccaagactggctacgagactgacatgattgagtccgacatggagctcgagaccgagctcggcattgactccatcaagcgtgtcgagattctctccgaggttcaggccatgctcaacgtcgaggccaaggacgtcgacgctctcagccgcactcgcactgttggtgaggtcgtcgatgccatgaaggctgagatcgctggcagctccgcctcggcgcctgccgccgctgctcctgctccggctgctgccgctcctgcgcccgctgccgccgcccctgctgtctcgaacgagcttctcgagaaagccgagactgtcgtcatggaggtcctcgccgccaagactggctacgagactgacatgatcgagtccgacatggagctcgagactgagctcggcattgactccatcaagcgtgtcgagatcctctccgaggttcaggccatgctcaacgtcgaggccaaggacgtcgatgccctcagccgcacccgcactgttggcgaggttgtcgatgccatgaaggccgagatcgctggtggctctgccccggcgcctgccgccgctgcccctgctccggctgccgccgcccctgctgtctcgaacgagcttctcgagaaggccgagactgtcgtcatggaggtcctcgccgccaagactggctacgagaccgacatgatcgagtccgacatggagctcgagaccgagctcggcattgactccatcaagcgtgtcgagattctctccgaggttcaggccatgctcaacgtcgaggccaaggacgtcgatgctctcagccgcactcgcactgttggcgaggtcgtcgatgccatgaaggctgagatcgccggcagctccgccccggcgcctgccgccgctgctcctgctccggctgctgccgctcctgcgcccgctgccgctgcccctgctgtctcgagcgagcttctcgagaaggccgagaccgtcgtcatggaggtcctcgccgccaagactggctacgagactgacatgattgagtccgacatggagctcgagactgagctcggcattgactccatcaagcgtgtcgagatcctctccgaggttcaggccatgctcaacgtcgaggccaaggacgtcgatgccctcagccgcacccgcactgttggcgaggttgtcgatgccatgaaggccgagatcgctggtggctctgccccggcgcctgccgccgctgcccctgctccggctgccgccgcccctgctgtctcgaacgagcttcttgagaaggccgagaccgtcgtcatggaggtcctcgccgccaagactggctacgagaccgacatgatcgagtccgacatggagctcgagaccgagctcggcattgactccatcaagcgtgtcgagattctctccgaggttcaggccatgctcaacgtcgaggccaaggacgtcgacgctctcagccgcactcgcactgttggcgaggtcgtcgatgccatgaaggctgagatcgctggtggctctgccccggcgcctgccgccgctgctcctgcctcggctggcgccgcgcctgcggtcaagattgactcggtccacggcgctgactgtgatgatctttccctgatgcacgccaaggtggttgacatccgccgcccggacgagctcatcctggagcgccccgagaaccgccccgttctcgttgtcgatgacggcagcgagctcaccctcgccctggtccgcgtcctcggcgcctgcgccgttgtcctgacctttgagggtctccagctcgctcagcgcgctggtgccgctgccatccgccacgtgctcgccaaggatctttccgcggagagcgccgagaaggccatcaaggaggccgagcagcgctttggcgctctcggcggcttcatctcgcagcaggcggagcgcttcgagcccgccgaaatcctcggcttcacgctcatgtgcgccaagttcgccaaggcttccctctgcacggctgtggctggcggccgcccggcctttatcggtgtggcgcgccttgacggccgcctcggattcacttcgcagggcacttctgacgcgctcaagcgtgcccagcgtggtgccatctttggcctctgcaagaccatcggcctcgagtggtccgagtctgacgtcttttcccgcggcgtggacattgctcagggcatgcaccccgaggatgccgccgtggcgattgtgcgcgagatggcgtgcgctgacattcgcattcgcgaggtcggcattggcgcaaaccagcagcgctgcacgatccgtgccgccaagctcgagaccggcaacccgcagcgccagatcgccaaggacgacgtgctgctcgtttctggcggcgctcgcggcatcacgcctctttgcatccgggagatcacgcgccagatcgcgggcggcaagtacattctgcttggccgcagcaaggtctctgcgagcgaaccggcatggtgcgctggcatcactgacgagaaggctgtgcaaaaggctgctacccaggagctcaagcgcgcctttagcgctggcgagggccccaagcccacgccccgcgctgtcactaagcttgtgggctctgttcttggcgctcgcgaggtgcgcagctctattgctgcgattgaagcgctcggcggcaaggccatctactcgtcgtgcgacgtgaactctgccgccgacgtggccaaggccgtgcgcgatgccgagtcccagctcggtgcccgcgtctcgggcatcgttcatgcctcgggcgtgctccgcgaccgtctcatcgagaagaagctccccgacgagttcgacgccgtctttggcaccaaggtcaccggtctcgagaacctcctcgccgccgtcgaccgcgccaacctcaagcacatggtcctcttcagctcgctcgccggcttccacggcaacgtcggccagtctgactacgccatggccaacgaggcccttaacaagatgggcctcgagctcgccaaggacgtctcggtcaagtcgatctgcttcggtccctgggacggtggcatggtgacgccgcagctcaagaagcagttccaggagatgggcgtgcagatcatcccccgcgagggcggcgctgataccgtggcgcgcatcgtgctcggctcctcgccggctgagatccttgtcggcaactggcgcaccccgtccaagaaggtcggctcggacaccatcaccctgcaccgcaagatttccgccaagtccaaccccttcctcgaggaccacgtcatccagggccgccgcgtgctgcccatgacgctggccattggctcgctcgcggagacctgcctcggcctcttccccggctactcgctctgggccattgacgacgcccagctcttcaagggtgtcactgtcgacggcgacgtcaactgcgaggtgaccctcaccccgtcgacggcgccctcgggccgcgtcaacgtccaggccacgctcaagaccttttccagcggcaagctggtcccggcctaccgcgccgtcatcgtgctctccaaccagggcgcgcccccggccaacgccaccatgcagccgccctcgctcgatgccgatccggcgctccagggctccgtctacgacggcaagaccctcttccacggcccggccttccgcggcatcgatgacgtgctctcgtgcaccaagagccagcttgtggccaagtgcagcgctgtccccggctccgacgccgctcgcggcgagtttgccacggacactgacgcccatgaccccttcgtgaacgacctggcctttcaggccatgctcgtctgggtgcgccgcacgctcggccaggctgcgctccccaactcgatccagcgcatcgtccagcaccgcccggtcccgcaggacaagcccttctacattaccctccgctccaaccagtcgggcggtcactcccagcacaagcacgcccttcagttccacaacgagcagggcgatctcttcattgatgtccaggcttcggtcatcgccacggacagccttgccttctaaatctaaactaggccatggtgacttaaggtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctagctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggccgctcgcaacgtgtctgcagcgcatgagatgcacgatgaaaagcgcatcgccgtcgtcggcatggccgtccagtacgccggatgcaaaaccaaggacgagttctgggaggtgctcatgaacggcaaggtcgagtccaaggtgatcagcgacaaacgactcggctccaactaccgcgccgagcactacaaagcagagcgcagcaagtatgccgacaccttttgcaacgaaacgtacggcacccttgacgagaacgagatcgacaacgagcacgaactcctcctcaacctcgccaagcaggcactcgcagagacatccgtcaaagactcgacacgctgcggcatcgtcagcggctgcctctcgttccccatggacaacctccagggtgaactcctcaacgtgtaccaaaaccatgtcgagaaaaagctcggggcccgcgtcttcaaggacgcctcccattggtccgaacgcgagcagtccaacaaacccgaggccggtgaccgccgcatcttcatggacccggcctccttcgtcgccgaagaactcaacctcggcgcccttcactactccgtcgacgcagcatgcgccacggcgctctacgtgctccgcctcgcgcaggatcatctcgtctccggcgccgccgacgtcatgctctgcggtgccacctgcctgccggagccctttttcatcctttcgggcttttccaccttccaggccatgcccgtcggcacgggccagaacgtgtccatgccgctgcacaaggacagccagggcctcaccccgggtgagggcggctccatcatggtcctcaagcgtctcgatgatgccatccgcgacggcgaccacatctacggcacccttctcggcgccaatgtcagcaactccggcacaggtctgcccctcaagccccttctccccagcgagaaaaagtgcctcatggacacctacacgcgcattaacgtgcacccgcacaagattcagtacgtcgagtgccacgccaccggcacgccccagggtgatcgtgtggaaatcgacgccgtcaaggcctgctttgaaggcaaggtcccccgtttcggtaccacaaagggcaactttggacacaccctcgtcgcagccggctttgccggtatgtgcaaggtcctcctctccatgaagcatggcatcatcccgcccaccccgggtatcgatgacgagaccaagatggaccctctcgtcgtctccggtgaggccatcccatggccagagaccaacggcgagcccaagcgcgccggtctctcggcctttggctttggtggcaccaacgcccatgccgtctttgaggagcatgacccctccaacgccgcctgcacgggccacgactccatttctgcgctctcggcccgctgcggcggtgaaagcaacatgcgcatcgccatcactggtatggacgccacctttggcgctctcaagggactcgacgccttcgagcgcgccatttacaccggcgctcacggtgccatcccactcccagaaaagcgctggcgctttctcggcaaggacaaggactttcttgacctctgcggcgtcaaggccaccccgcacggctgctacattgaagatgttgaggtcgacttccagcgcctccgcacgcccatgacccctgaagacatgctcctccctcagcagcttctggccgtcaccaccattgaccgcgccatcctcgactcgggaatgaaaaagggtggcaatgtcgccgtctttgtcggcctcggcaccgacctcgagctctaccgtcaccgtgctcgcgtcgctctcaaggagcgcgtccgccctgaagcctccaagaagctcaatgacatgatgcagtacattaacgactgcggcacatccacatcgtacacctcgtacattggcaacctcgtcgccacgcgcgtctcgtcgcagtggggcttcacgggcccctcctttacgatcaccgagggcaacaactccgtctaccgctgcgccgagctcggcaagtacctcctcgagaccggcgaggtcgatggcgtcgtcgttgcgggtgtcgatctctgcggcagtgccgaaaacctttacgtcaagtctcgccgcttcaaggtgtccacctccgataccccgcgcgccagctttgacgccgccgccgatggctactttgtcggcgagggctgcggtgcctttgtgctcaagcgtgagactagctgcaccaaggacgaccgtatctacgcttgcatggatgccatcgtccctggcaacgtccctagcgcctgcttgcgcgaggccctcgaccaggcgcgcgtcaagccgggcgatatcgagatgctcgagctcagcgccgactccgcccgccacctcaaggacccgtccgtcctgcccaaggagctcactgccgaggaggaaatcggcggccttcagacgatccttcgtgacgatgacaagctcccgcgcaacgtcgcaacgggcagtgtcaaggccaccgtcggtgacaccggttatgcctctggtgctgccagcctcatcaaggctgcgctttgcatctacaaccgctacctgcccagcaacggcgacgactgggatgaacccgcccctgaggcgccctgggacagcaccctctttgcgtgccagacctcgcgcgcttggctcaagaaccctggcgagcgtcgctatgcggccgtctcgggcgtctccgagacgcgctcgtgctattccgtgctcctctccgaagccgagggccactacgagcgcgagaaccgcatctcgctcgacgaggaggcgcccaagctcattgtgcttcgcgccgactcccacgaggagatccttggtcgcctcgacaagatccgcgagcgcttcttgcagcccacgggcgccgccccgcgcgagtccgagctcaaggcgcaggcccgccgcatcttcctcgagctcctcggcgagacccttgcccaggatgccgcttcttcaggctcgcaaaagcccctcgctctcagcctcgtctccacgccctccaagctccagcgcgaggtcgagctcgcggccaagggtatcccgcgctgcctcaagatgcgccgcgattggagctcccctgctggcagccgctacgcgcctgagccgctcgccagcgaccgcgtcgccttcatgtacggcgaaggtcgcagcccttactacggcatcacccaagacattcaccgcatttggcccgaactccacgaggtcatcaacgaaaagacgaaccgtctctgggccgaaggcgaccgctgggtcatgccgcgcgccagcttcaagtcggagctcgagagccagcagcaagagtttgatcgcaacatgattgaaatgttccgtcttggaatcctcacctcaattgccttcaccaatctggcgcgcgacgttctcaacatcacgcccaaggccgcctttggcctcagtcttggcgagatttccatgatttttgccttttccaagaagaacggtctcatctccgaccagctcaccaaggatcttcgcgagtccgacgtgtggaacaaggctctggccgttgaatttaatgcgctgcgcgaggcctggggcattccacagagtgtccccaaggacgagttctggcaaggctacattgtgcgcggcaccaagcaggatatcgaggcggccatcgccccggacagcaagtacgtgcgcctcaccatcatcaatgatgccaacaccgccctcattagcggcaagcccgacgcctgcaaggctgcgatcgcgcgtctcggtggcaacattcctgcgcttcccgtgacccagggcatgtgcggccactgccccgaggtgggaccttataccaaggatatcgccaagatccatgccaaccttgagttccccgttgtcgacggccttgacctctggaccacaatcaaccagaagcgcctcgtgccacgcgccacgggcgccaaggacgaatgggccccttcttcctttggcgagtacgccggccagctctacgagaagcaggctaacttcccccaaatcgtcgagaccatttacaagcaaaactacgacgtctttgtcgaggttgggcccaacaaccaccgtagcaccgcagtgcgcaccacgcttggtccccagcgcaaccaccttgctggcgccatcgacaagcagaacgaggatgcttggacgaccatcgtcaagcttgtggcttcgctcaaggcccaccttgttcctggcgtcacgatctcgccgctgtaccactccaagcttgtggcggaggctgaggcttgctacgctgcgctctgcaagggtgaaaagcccaagaagaacaagtttgtgcgcaagattcagctcaacggtcgcttcaacagcaaggcggaccccatctcctcggccgatcttgccagctttccgcctgcggaccctgccattgaagccgccatctcgagccgcatcatgaagccggttgctccgaagttctacgcgcgtctcaacattgacgagcaggacgagacccgtgatccgatcctcaacaaggacaacgcgccgtcttccagctctagctcctcttccagctcttccagctcttccagcccgtcgccagctccgtccgccccagtgcaaaagaaggctgctccggccgcggagaccaaggctgttgcttcggctgacgcacttcgcagtgccctgctcgatctcgacagtatgcttgcgctgagctctgccagtgcctccggcaaccttgttgagactgcgcctagcgacgcctcggtcattgtgccgccctgcaacattgcggatctcggcagccgcgccttcatgaaaacgtacggtgtttcggcgcctctgtacacgggcgccatggccaagggcattgcctctgcggacctcgtcattgccgccggccgccagggcatccttgcgtcctttggcgccggcggacttcccatgcaggttgtgcgtgagtccatcgaaaagattcaggccgccctgcccaatggcccgtacgctgtcaaccttatccattctccctttgacagcaacctcgaaaagggcaatgtcgatctcttcctcgagaagggtgtcacctttgtcgaggcctcggcctttatgacgctcaccccgcaggtcgtgcggtaccgcgcggctggcctcacgcgcaacgccgacggctcggtcaacatccgcaaccgtatcattggcaaggtctcgcgcaccgagctcgccgagatgttcatgcgtcctgcgcccgagcaccttcttcagaagctcattgcttccggcgagatcaaccaggagcaggccgagctcgcccgccgtgttcccgtcgctgacgacatcgcggtcgaagctgactcgggtggccacaccgacaaccgccccatccacgtcattctgcccctcatcatcaaccttcgcgaccgccttcaccgcgagtgcggctacccggccaaccttcgcgtccgtgtgggcgccggcggtggcattgggtgcccccaggcggcgctggccaccttcaacatgggtgcctcctttattgtcaccggcaccgtgaaccaggtcgccaagcagtcgggcacgtgcgacaatgtgcgcaagcagctcgcgaaggccacttactcggacgtatgcatggccccggctgccgacatgttcgaggaaggcgtcaagcttcaggtcctcaagaagggaaccatgtttccctcgcgcgccaacaagctctacgagctcttttgcaagtacgactcgttcgagtccatgccccccgcagagcttgcgcgcgtcgagaagcgcatcttcagccgcgcgctcgaagaggtctgggacgagaccaaaaacttttacattaaccgtcttcacaacccggagaagatccagcgcgccgagcgcgaccccaagctcaagatgtcgctgtgctttcgctggtacctgagcctggcgagccgctgggccaacactggagcttccgatcgcgtcatggactaccaggtctggtgcggtcctgccattggttccttcaacgatttcatcaagggaacttaccttgatccggccgtcgcaaacgagtacccgtgcgtcgttcagattaacaagcagatccttcgtggagcgtgcttcttgcgccgtctcgaaattctgcgcaacgcacgcctttccgatggcgctgccgctcttgtggccagcatcgatgacacatacgtcccggccgagaagctgtaagcggccgcatttaaatggatccactaggccatggtgacttaaggtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctagctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaacatatggcgctccgtgtcaagacgaacaagaagccatgctgggagatgaccaaggaggagctgaccagcggcaagaccgaggtgttcaactatgaggaactcctcgagttcgcagagggcgacatcgccaaggtcttcggacccgagttcgccgtcatcgacaagtacccgcgccgcgtgcgcctgcccgcccgcgagtacctgctcgtgacccgcgtcaccctcatggacgccgaggtcaacaactaccgcgtcggcgcccgcatggtcaccgagtacgatctccccgtcaacggagagctctccgagggcggagactgcccctgggccgtcctggtcgagagtggccagtgcgatctcatgctcatctcctacatgggcattgacttccagaaccagggcgaccgcgtctaccgcctgctcaacaccacgctcaccttttacggcgtggcccacgagggcgagaccctcgagtacgacattcgcgtcaccggcttcgccaagcgtctcgacggcggcatctccatgttcttcttcgagtacgactgctacgtcaacggccgcctcctcatcgagatgcgcgatggctgcgccggcttcttcaccaacgaggagctcgacgccggcaagggcgtcgtcttcacccgcggcgacctcgccgcccgcgccaagatcccaaagcaggacgtctccccctacgccgtcgccccctgcctccacaagaccaagctcaacgaaaaggagatgcagaccctcgtcgacaaggactgggcatccgtctttggctccaagaacggcatgccggaaatcaactacaaactctgcgcgcgtaagatgctcatgattgaccgcgtcaccagcattgaccacaagggcggtgtctacggcctcggtcagctcgtcggtgaaaagatcctcgagcgcgaccactggtactttccctgccactttgtcaaggatcaggtcatggccggatccctcgtctccgacggctgcagccagatgctcaagatgtacatgatctggctcggcctccacctcaccaccggaccctttgacttccgcccggtcaacggccaccccaacaaggtccgctgccgcggccaaatctccccgcacaagggcaagctcgtctacgtcatggagatcaaggagatgggcttcgacgaggacaacgacccgtacgccattgccgacgtcaacatcattgatgtcgacttcgaaaagggccaggactttagcctcgaccgcatcagcgactacggcaagggcgacctcaacaagaagatcgtcgtcgactttaagggcatcgctctcaagatgcagaagcgctccaccaacaagaacccctccaaggttcagcccgtctttgccaacggcgccgccactgtcggccccgaggcctccaaggcttcctccggcgccagcgccagcgccagcgccgccccggccaagcctgccttcagcgccgatgttcttgcgcccaagcccgttgcccttcccgagcacatcctcaagggcgacgccctcgcccccaaggagatgtcctggcaccccatggcccgcatcccgggcaacccgacgccctcttttgcgccctcggcctacaagccgcgcaacatcgcctttacgcccttccccggcaaccccaacgataacgaccacaccccgggcaagatgccgctcacctggttcaacatggccgagttcatggccggcaaggtcagcatgtgcctcggccccgagttcgccaagttcgacgactcgaacaccagccgcagccccgcttgggacctcgctctcgtcacccgcgccgtgtctgtgtctgacctcaagcacgtcaactaccgcaacatcgacctcgacccctccaagggtaccatggtcggcgagttcgactgccccgcggacgcctggttctacaagggcgcctgcaacgatgcccacatgccgtactcgatcctcatggagatcgccctccagacctcgggtgtgctcacctcggtgctcaaggcgcccctgaccatggagaaggacgacatcctcttccgcaacctcgacgccaacgccgagttcgtgcgcgccgacctcgactaccgcggcaagactatccgcaacgtcaccaagtgcactggctacagcatgctcggcgagatgggcgtccaccgcttcacctttgagctctacgtcgatgatgtgctcttttacaagggctcgacctcgttcggctggttcgtgcccgaggtctttgccgcccaggccggcctcgacaacggccgcaagtcggagccctggttcattgagaacaaggttccggcctcgcaggtctcctcctttgacgtgcgccccaacggcagcggccgcaccgccatcttcgccaacgcccccagcggcgcccagctcaaccgccgcacggaccagggccagtacctcgacgccgtcgacattgtctccggcagcggcaagaagagcctcggctacgcccacggttccaagacggtcaacccgaacgactggttcttctcgtgccacttttggtttgactcggtcatgcccggaagtctcggtgtcgagtccatgttccagctcgtcgaggccatcgccgcccacgaggatctcgctggcaagcacggcattgccaaccccacctttgtgcacgccccgggcaagatcagctggaagtaccgcggccagctcacgcccaagagcaagaagatggactcggaggtccacatcgtgtccgtggacgcccacgacggcgttgtcgacctcgtcgccgacggcttcctctgggccgacagcctccgcgtctactcggtgagcaacattcgcgtgcgcatcgcctccggtgaggcccctgccgccgcctcctccgccgcctctgtgggctcctcggcttcgtccgtcgagcgcacgcgctcgagccccgctgtcgcctccggcccggcccagaccatcgacctcaagcagctcaagaccgagctcctcgagctcgatgccccgctctacctctcgcaggacccgaccagcggccagctcaagaagcacaccgacgtggcctccggccaggccaccatcgtgcagccctgcacgctcggcgacctcggtgaccgctccttcatggagacctacggcgtcgtcgccccgctgtacacgggcgccatggccaagggcattgcctcggcggacctcgtcatcgccgccggcaagcgcaagatcctcggctcctttggcgccggcggcctccccatgcaccacgtgcgcgccgccctcgagaagatccaggccgccctgcctcagggcccctacgccgtcaacctcatccactcgccttttgacagcaacctcgagaagggcaacgtcgatctcttcctcgagaagggcgtcactgtggtggaggcctcggcattcatgaccctcaccccgcaggtcgtgcgctaccgcgccgccggcctctcgcgcaacgccgacggttcggtcaacatccgcaaccgcatcatcggcaaggtctcgcgcaccgagctcgccgagatgttcatccgcccggccccggagcacctcctcgagaagctcatcgcctcgggcgagatcacccaggagcaggccgagctcgcgcgccgcgttcccgtcgccgacgatatcgctgtcgaggctgactcgggcggccacaccgacaaccgccccatccacgtcatcctcccgctcatcatcaacctccgcaaccgcctgcaccgcgagtgcggctaccccgcgcacctccgcgtccgcgttggcgccggcggtggcgtcggctgcccgcaggccgccgccgccgcgctcaccatgggcgccgccttcatcgtcaccggcactgtcaaccaggtcgccaagcagtccggcacctgcgacaacgtgcgcaagcagctctcgcaggccacctactcggatatctgcatggccccggccgccgacatgttcgaggagggcgtcaagctccaggtcctcaagaagggaaccatgttcccctcgcgcgccaacaagctctacgagctcttttgcaagtacgactccttcgactccatgcctcctgccgagctcgagcgcatcgagaagcgtatcttcaagcgcgcactccaggaggtctgggaggagaccaaggacttttacattaacggtctcaagaacccggagaagatccagcgcgccgagcacgaccccaagctcaagatgtcgctctgcttccgctggtaccttggtcttgccagccgctgggccaacatgggcgccccggaccgcgtcatggactaccaggtctggtgtggcccggccattggcgccttcaacgacttcatcaagggcacctacctcgaccccgctgtctccaacgagtacccctgtgtcgtccagatcaacctgcaaatcctccgtggtgcctgctacctgcgccgtctcaacgccctgcgcaacgacccgcgcattgacctcgagaccgaggatgctgcctttgtctacgagcccaccaacgcgctctaagctagcatttaaatctaggccatggtgacttaaggtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggcgagtcatgagtcgtgacatgacgtcatgctcatcagactgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaacctaccatggctcccactcccgacgccaccgcgcctctgaacaagccgagcgactatgccgtctaccacgaggaagacggccccttctggaccgccgattccagcggcgtctcgcgcgtgaactttagcgagaccggcgtgggatccgagggcgtcatccctgcgctcacgctcatcgacgtcttcgagagggccgtcaagcgcggcggaaacaggatcgccttccgcacggaaaacatgcccacgctccgccgcggcgaagaggccccggacgcgctgccgctcaaggactggaagtcctggtcctggaaacagtacaaggccgacgtccaccgcatcgccagggctctcatggacctcggcgttgagcagcatgacgccgtctccatttttggctttaactcgcccgaatggtttctcagtgccgtcggcgccgtgcacgcaggtgccaagattgccggcatttacccctcagacacgcccgcccaggtccagtacaaggccttccacagtgacaccgctgttgccgttgtcgaaaacgagcagtgcttcaagaagttcgccgaggtcgtcgaggaccttccttacctcaaggccattgtttgctgggactatgaagccacagacatcacgcgcgaggacggctccgtcgtcgaggtcctcacctttgccgagttcctcaagcgcggcgacaccgtcgaggcggccgcccttgacgagcgcatctccaagatcgagcccaccatgtgcgctgcccttatttacaccagcggtactaccggccgccccaaggccgttatgatttcgcacgacaaccttgttttcgaggccagcgccgtcgtccccaacctcggaggagcctgtacgaccactgctgaggagcgcattctctcgtacctgcctctctcgcacgtcgctggtatgatggttgatattattgcccccatcattgccaccgccttccacaagggccgcatctgcgtctgctttgctcgcccgtacgatttgcgcaccggcacgctgggccagcgcctcaacgccgtggagcccaccatcttccttggcgtgccccgtgtgtgggaaaagattcaggaaaagctcatggccgtcggtgccaaaaccaccggcctcaagaagaagctctctacggccgccaagaagcgtggtcttgaattccaggaggagcagcaaatcggccgctccggtgccaaccctggctttggcccccttggcatctacaagaagctcctcggcctcatcaagggcaagctgggcctcaccaagtgcaagtttgcctttgctggtgccgcgcccatgacccgtgagacccttcagtactttggcgcgctgaacatcaacattaacgaggtctacggcatgtccgagtgctccggtgccgccacctggtccacggacaaggcccacgagtggggcactgttggctacgagatgcccagttgcgaggtccgcgtcttcaagattgccgaggacggtaccaagaccgagtgcccgcgcgccgccgacattatgcatgctaccgaggaggagcagggcgaagtttgcttccgcggccgtaacatcatgatgggctaccttgccaaccccaagcttggcgacgaccacgttgccgagatcgaggagaagaacgctgccgctatcgactccgagggctggctccacagtggtgataagggcgccatttctacccgcggcatgctcaagatcacgggccgctacaaggagctcatcatcggcgccggtggcgagaacgtggcgcccgtccctattgaggacgccatcaaggcgcgcatgccttttgtttccaacgccatgatggtcggagataagcgcaagttcatggctgtcctccttaccctcaagacggttggcgccacgggcgagcttcccggtacgaacaagctcatgggcgctgccgccgactatggtgagaccatcgaggacgcctgcgacaacgaggcgctcattgaggagatcacgcagcagctcaaggagatcggtgatgatggcgatgtcacgccctcgaacgcggctcgcatccaaaagttcaccattctcccgctcgacttttccgtctccacggacgagctcacggccacgctcaagctcaagcgctccgtggtcgcagacaagtacgaagacatcatcgaggccttttacgagtccaagagcgtttttgtgccgtactcgaccgttggcgcctacgccacgggcggcccggtcgacgactccgttgtcgatggctccttcaagggcgactttagcatgattggcgacgatgatccggatcttcaaaacgtcgatgtcctcgaggcgattgacgaggacaattaaatttccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgatcatggatgctacgtcacggcagtacaggactatcactagagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgttgcagcatacttggctaccaaaacccccaaatttaaccttattgtcagatgaagttcatctctggcgcattccccttgaccaaccagaatcacagctacaggatttagccgctaccttatctagtgacgaattagcccgtgcaaacagattttattttcccgaacatcgccggcgttttactgctggtcgtggtattctccgcagtatcttggggggctatttgggtgtggaaccagggcaagttaaatttgattatgaatcccgtggtaaaccaatattaggcgatcgctttgccgagagtggtttattatttaacttgtcacactcccagaacttggccttgtgtgcagtcaattacacgcgccaaatcggcatcgatttagaatatctccgccccacatctgatttagaatcccttgccaaaaggttctttttaccgcgagaatatgaattattgcgatcgctacccgatgagcaaaaacaaaaaattttctttcgttactggacttgtaaagaggcttatcttaaagcaacgggtgacggcatcgctaaattagaggaaattgaaatagcactaactcccacagaaccagctaagttacagacagctccagcgtggagtctcctagagctagtgccagatgataattgtgttgctgctgttgccgtggcgggttttggctggcagccaaaattctggcattattgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcctagtgctagcctcgaggtcgacacccagcttt

SEQ ID NO: 34 - DNA, 35302 bp, Artificial sequence
  plasmid pDAB7368
ttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctagctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcggcccgtctgcaggagcaaaagggaggcgagatggatacccgcattgccatcatcggcatgtcggccatcctcccctgcggcacgaccgtgcgcgagtcgtgggagaccatccgcgccggcatcgactgcctgtcggatctccccgaggaccgcgtcgacgtgacggcgtactttgaccccgtcaagaccaccaaggacaagatctactgcaagcgcggtggcttcattcccgagtacgactttgacgcccgcgagttcggactcaacatgttccagatggaggactcggacgcaaaccagaccatctcgcttctcaaggtcaaggaggccctccaggacgccggcatcgacgccctcggcaaggaaaagaagaacatcggctgcgtgctcggcattggcggcggccaaaagtccagccacgagttctactcgcgccttaattatgttgtcgtggagaaggtcctccgcaagatgggcatgcccgaggaggacgtcaaggtcgccgtcgaaaagtacaaggccaacttccccgagtggcgcctcgactccttccctggcttcctcggcaacgtcaccgccggtcgctgcaccaacaccttcaacctcgacggcatgaactgcgttgtcgacgccgcatgcgcctcgtccctcatcgccgtcaaggtcgccatcgacgagctgctctacggtgactgcgacatgatggtcaccggtgccacctgcacggataactccatcggcatgtacatggccttctccaagacccccgtgttctccacggaccccagcgtgcgcgcctacgacgaaaagacaaagggcatgctcatcggcgagggctccgccatgctcgtcctcaagcgctacgccgacgccgtccgcgacggcgatgagatccacgctgttattcgcggctgcgcctcctccagtgatggcaaggccgccggcatctacacgcccaccatttcgggccaggaggaggccctccgccgcgcctacaaccgcgcctgtgtcgacccggccaccgtcactctcgtcgagggtcacggcaccggtactcccgttggcgaccgcatcgagctcaccgccttgcgcaacctctttgacaaggcctacggcgagggcaacaccgaaaaggtcgctgtgggcagcatcaagtccagcatcggccatctcaaggccgtcgccggtctcgccggtatgatcaaggtcatcatggcgctcaagcacaagactctcccgggcaccatcaacgtcgacaacccacccaacctctacgacaacacgcccatcaacgagtcctcgctctacattaacaccatgaaccgcccctggttcccgccccctggtgtgccccgccgcgccggcatttcgagctttggctttggtggcgccaactaccacgccgtcctcgaggaggccgagcccgagcacacgaccgcgtaccgcctcaacaagcgcccgcagcccgtgctcatgatggccgccacgcccgcggccctccagtcgctctgcgaggcccagctcaaggagttcgaggccgccatcaaggagaacgagaccgtcaagaacaccgcctacatcaagtgcgtcaagttcggcgagcagttcaaattccctggctccatcccggccacaaacgcgcgcctcggcttcctcgtcaaggatgctgaggatgcctgctccaccctccgtgccatctgcgcccaattcgccaaggatgtcaccaaggaggcctggcgcctcccccgcgagggcgtcagcttccgcgccaagggcatcgccaccaacggcgctgtcgccgcgctcttctccggccagggcgcgcagtacacgcacatgtttagcgaggtggccatgaactggccccagttccgccagagcattgccgccatggacgccgcccagtccaaggtcgctggaagcgacaaggactttgagcgcgtctcccaggtcctctacccgcgcaagccgtacgagcgtgagcccgagcaggaccacaagaagatctccctcaccgcctactcgcagccctcgaccctggcctgcgctctcggtgcctttgagatcttcaaggaggccggcttcaccccggactttgccgccggccattcgctcggtgagttcgccgccctctacgccgcgggctgcgtcgaccgcgacgagctctttgagcttgtctgccgccgcgcccgcatcatgggcggcaaggacgcaccggccacccccaagggctgcatggccgccgtcattggccccaacgccgagaacatcaaggtccaggccgccaacgtctggctcggcaactccaactcgccttcgcagaccgtcatcaccggctccgtcgaaggtatccaggccgagagcgcccgcctccagaaggagggcttccgcgtcgtgcctcttgcctgcgagagcgccttccactcgccccagatggagaacgcctcgtcggccttcaaggacgtcatctccaaggtctccttccgcacccccaaggccgagaccaagctcttcagcaacgtctctggcgagacctaccccacggacgcccgcgagatgcttacgcagcacatgaccagcagcgtcaagttcctcacccaggtccgcaacatgcaccaggccggtgcgcgcatctttgtcgagttcggacccaagcaggtgctctccaagcttgtctccgagaccctcaaggatgacccctcggttgtcaccgtctctgtcaacccggcctcgggcacggattcggacatccagctccgcgacgcggccgtccagctcgttgtcgctggcgtcaaccttcagggctttgacaagtgggacgcccccgatgccacccgcatgcaggccatcaagaagaagcgcactaccctccgcctttcggccgccacctacgtctcggacaagaccaagaaggtccgcgacgccgccatgaacgatggccgctgcgtcacctacctcaagggcgccgcaccgctcatcaaggccccggagcccgttgtcgacgaggccgccaagcgcgaggccgagcgtctccagaaggagcttcaggatgcccagcgccagctcgacgacgccaagcgcgccgccgccgaggccaactccaagctcgccgctgccaaggaggaggccaagaccgccgctgcttcggccaagcccgcagttgacactgctgttgtcgaaaagcatcgtgccatcctcaagtccatgctcgcggagctcgatggctacggatcggtcgacgcttcttccctccagcagcagcagcagcagcagacggcccccgccccggtcaaggctgctgcgcctgccgcccccgttgcctcggcccctgccccggctgtctcgaacgagcttcttgagaaggccgagactgtcgtcatggaggtcctcgccgccaagaccggctacgagaccgacatgatcgaggctgacatggagctcgagaccgagctcggcattgactccatcaagcgtgtcgagatcctctccgaggtccaggccatgctcaatgtcgaggccaaggatgtcgatgccctcagccgcactcgcactgttggtgaggttgtcaacgccatgaaggccgagatcgctggcagctctgccccggcgcctgctgccgctgctccggctccggccaaggctgcccctgccgccgctgcgcctgctgtctcgaacgagcttctcgagaaggccgagaccgtcgtcatggaggtcctcgccgccaagactggctacgagactgacatgatcgagtccgacatggagctcgagactgagctcggcattgactccatcaagcgtgtcgagatcctctccgaggttcaggccatgctcaacgtcgaggccaaggacgtcgacgctctcagccgcactcgcactgtgggtgaggtcgtcaacgccatgaaggctgagatcgctggtggctctgccccggcgcctgccgccgctgccccaggtccggctgctgccgcccctgcgcctgccgccgccgcccctgctgtctcgaacgagcttcttgagaaggccgagaccgtcgtcatggaggtcctcgccgccaagactggctacgagactgacatgatcgagtccgacatggagctcgagaccgagctcggcattgactccatcaagcgtgtcgagattctctccgaggtccaggccatgctcaacgtcgaggccaaggacgtcgacgctctcagccgcacccgcactgttggcgaggtcgtcgatgccatgaaggccgagatcgctggtggctctgccccggcgcctgccgccgctgctcctgctccggctgctgccgcccctgcgcctgccgcccctgcgcctgctgtctcgagcgagcttctcgagaaggccgagactgtcgtcatggaggtcctcgccgccaagactggctacgagactgacatgatcgagtccgacatggagctcgagaccgagctcggcattgactccatcaagcgtgtcgagattctctccgaggtccaggccatgctcaacgtcgaggccaaggacgtcgacgctctcagccgcacccgcactgttggcgaggtcgtcgatgccatgaaggccgagatcgctggtggctctgccccggcgcctgccgccgctgctcctgctccggctgctgccgcccctgcgcctgccgcccctgcgcctgccgcccctgcgcctgctgtctcgagcgagcttctcgagaaggccgagactgtcgtcatggaggtcctcgccgccaagactggctacgagactgacatgattgagtccgacatggagctcgagaccgagctcggcattgactccatcaagcgtgtcgagattctctccgaggttcaggccatgctcaacgtcgaggccaaggacgtcgacgctctcagccgcactcgcactgttggtgaggtcgtcgatgccatgaaggctgagatcgctggcagctccgcctcggcgcctgccgccgctgctcctgctccggctgctgccgctcctgcgcccgctgccgccgcccctgctgtctcgaacgagcttctcgagaaagccgagactgtcgtcatggaggtcctcgccgccaagactggctacgagactgacatgatcgagtccgacatggagctcgagactgagctcggcattgactccatcaagcgtgtcgagatcctctccgaggttcaggccatgctcaacgtcgaggccaaggacgtcgatgccctcagccgcacccgcactgttggcgaggttgtcgatgccatgaaggccgagatcgctggtggctctgccccggcgcctgccgccgctgcccctgctccggctgccgccgcccctgctgtctcgaacgagcttctcgagaaggccgagactgtcgtcatggaggtcctcgccgccaagactggctacgagaccgacatgatcgagtccgacatggagctcgagaccgagctcggcattgactccatcaagcgtgtcgagattctctccgaggttcaggccatgctcaacgtcgaggccaaggacgtcgatgctctcagccgcactcgcactgttggcgaggtcgtcgatgccatgaaggctgagatcgccggcagctccgccccggcgcctgccgccgctgctcctgctccggctgctgccgctcctgcgcccgctgccgctgcccctgctgtctcgagcgagcttctcgagaaggccgagaccgtcgtcatggaggtcctcgccgccaagactggctacgagactgacatgattgagtccgacatggagctcgagactgagctcggcattgactccatcaagcgtgtcgagatcctctccgaggttcaggccatgctcaacgtcgaggccaaggacgtcgatgccctcagccgcacccgcactgttggcgaggttgtcgatgccatgaaggccgagatcgctggtggctctgccccggcgcctgccgccgctgcccctgctccggctgccgccgcccctgctgtctcgaacgagcttcttgagaaggccgagaccgtcgtcatggaggtcctcgccgccaagactggctacgagaccgacatgatcgagtccgacatggagctcgagaccgagctcggcattgactccatcaagcgtgtcgagattctctccgaggttcaggccatgctcaacgtcgaggccaaggacgtcgacgctctcagccgcactcgcactgttggcgaggtcgtcgatgccatgaaggctgagatcgctggtggctctgccccggcgcctgccgccgctgctcctgcctcggctggcgccgcgcctgcggtcaagattgactcggtccacggcgctgactgtgatgatctttccctgatgcacgccaaggtggttgacatccgccgcccggacgagctcatcctggagcgccccgagaaccgccccgttctcgttgtcgatgacggcagcgagctcaccctcgccctggtccgcgtcctcggcgcctgcgccgttgtcctgacctttgagggtctccagctcgctcagcgcgctggtgccgctgccatccgccacgtgctcgccaaggatctttccgcggagagcgccgagaaggccatcaaggaggccgagcagcgctttggcgctctcggcggcttcatctcgcagcaggcggagcgcttcgagcccgccgaaatcctcggcttcacgctcatgtgcgccaagttcgccaaggcttccctctgcacggctgtggctggcggccgcccggcctttatcggtgtggcgcgccttgacggccgcctcggattcacttcgcagggcacttctgacgcgctcaagcgtgcccagcgtggtgccatctttggcctctgcaagaccatcggcctcgagtggtccgagtctgacgtcttttcccgcggcgtggacattgctcagggcatgcaccccgaggatgccgccgtggcgattgtgcgcgagatggcgtgcgctgacattcgcattcgcgaggtcggcattggcgcaaaccagcagcgctgcacgatccgtgccgccaagctcgagaccggcaacccgcagcgccagatcgccaaggacgacgtgctgctcgtttctggcggcgctcgcggcatcacgcctctttgcatccgggagatcacgcgccagatcgcgggcggcaagtacattctgcttggccgcagcaaggtctctgcgagcgaaccggcatggtgcgctggcatcactgacgagaaggctgtgcaaaaggctgctacccaggagctcaagcgcgcctttagcgctggcgagggccccaagcccacgccccgcgctgtcactaagcttgtgggctctgttcttggcgctcgcgaggtgcgcagctctattgctgcgattgaagcgctcggcggcaaggccatctactcgtcgtgcgacgtgaactctgccgccgacgtggccaaggccgtgcgcgatgccgagtcccagctcggtgcccgcgtctcgggcatcgttcatgcctcgggcgtgctccgcgaccgtctcatcgagaagaagctccccgacgagttcgacgccgtctttggcaccaaggtcaccggtctcgagaacctcctcgccgccgtcgaccgcgccaacctcaagcacatggtcctcttcagctcgctcgccggcttccacggcaacgtcggccagtctgactacgccatggccaacgaggcccttaacaagatgggcctcgagctcgccaaggacgtctcggtcaagtcgatctgcttcggtccctgggacggtggcatggtgacgccgcagctcaagaagcagttccaggagatgggcgtgcagatcatcccccgcgagggcggcgctgataccgtggcgcgcatcgtgctcggctcctcgccggctgagatccttgtcggcaactggcgcaccccgtccaagaaggtcggctcggacaccatcaccctgcaccgcaagatttccgccaagtccaaccccttcctcgaggaccacgtcatccagggccgccgcgtgctgcccatgacgctggccattggctcgctcgcggagacctgcctcggcctcttccccggctactcgctctgggccattgacgacgcccagctcttcaagggtgtcactgtcgacggcgacgtcaactgcgaggtgaccctcaccccgtcgacggcgccctcgggccgcgtcaacgtccaggccacgctcaagaccttttccagcggcaagctggtcccggcctaccgcgccgtcatcgtgctctccaaccagggcgcgcccccggccaacgccaccatgcagccgccctcgctcgatgccgatccggcgctccagggctccgtctacgacggcaagaccctcttccacggcccggccttccgcggcatcgatgacgtgctctcgtgcaccaagagccagcttgtggccaagtgcagcgctgtccccggctccgacgccgctcgcggcgagtttgccacggacactgacgcccatgaccccttcgtgaacgacctggcctttcaggccatgctcgtctgggtgcgccgcacgctcggccaggctgcgctccccaactcgatccagcgcatcgtccagcaccgcccggtcccgcaggacaagcccttctacattaccctccgctccaaccagtcgggcggtcactcccagcacaagcacgcccttcagttccacaacgagcagggcgatctcttcattgatgtccaggcttcggtcatcgccacggacagccttgccttctaaatctaaactaggccatggtgacttaaggtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctagctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggccgctcgcaacgtgtctgcagcgcatgagatgcacgatgaaaagcgcatcgccgtcgtcggcatggccgtccagtacgccggatgcaaaaccaaggacgagttctgggaggtgctcatgaacggcaaggtcgagtccaaggtgatcagcgacaaacgactcggctccaactaccgcgccgagcactacaaagcagagcgcagcaagtatgccgacaccttttgcaacgaaacgtacggcacccttgacgagaacgagatcgacaacgagcacgaactcctcctcaacctcgccaagcaggcactcgcagagacatccgtcaaagactcgacacgctgcggcatcgtcagcggctgcctctcgttccccatggacaacctccagggtgaactcctcaacgtgtaccaaaaccatgtcgagaaaaagctcggggcccgcgtcttcaaggacgcctcccattggtccgaacgcgagcagtccaacaaacccgaggccggtgaccgccgcatcttcatggacccggcctccttcgtcgccgaagaactcaacctcggcgcccttcactactccgtcgacgcagcatgcgccacggcgctctacgtgctccgcctcgcgcaggatcatctcgtctccggcgccgccgacgtcatgctctgcggtgccacctgcctgccggagccctttttcatcctttcgggcttttccaccttccaggccatgcccgtcggcacgggccagaacgtgtccatgccgctgcacaaggacagccagggcctcaccccgggtgagggcggctccatcatggtcctcaagcgtctcgatgatgccatccgcgacggcgaccacatctacggcacccttctcggcgccaatgtcagcaactccggcacaggtctgcccctcaagccccttctccccagcgagaaaaagtgcctcatggacacctacacgcgcattaacgtgcacccgcacaagattcagtacgtcgagtgccacgccaccggcacgccccagggtgatcgtgtggaaatcgacgccgtcaaggcctgctttgaaggcaaggtcccccgtttcggtaccacaaagggcaactttggacacaccctcgtcgcagccggctttgccggtatgtgcaaggtcctcctctccatgaagcatggcatcatcccgcccaccccgggtatcgatgacgagaccaagatggaccctctcgtcgtctccggtgaggccatcccatggccagagaccaacggcgagcccaagcgcgccggtctctcggcctttggctttggtggcaccaacgcccatgccgtctttgaggagcatgacccctccaacgccgcctgcacgggccacgactccatttctgcgctctcggcccgctgcggcggtgaaagcaacatgcgcatcgccatcactggtatggacgccacctttggcgctctcaagggactcgacgccttcgagcgcgccatttacaccggcgctcacggtgccatcccactcccagaaaagcgctggcgctttctcggcaaggacaaggactttcttgacctctgcggcgtcaaggccaccccgcacggctgctacattgaagatgttgaggtcgacttccagcgcctccgcacgcccatgacccctgaagacatgctcctccctcagcagcttctggccgtcaccaccattgaccgcgccatcctcgactcgggaatgaaaaagggtggcaatgtcgccgtctttgtcggcctcggcaccgacctcgagctctaccgtcaccgtgctcgcgtcgctctcaaggagcgcgtccgccctgaagcctccaagaagctcaatgacatgatgcagtacattaacgactgcggcacatccacatcgtacacctcgtacattggcaacctcgtcgccacgcgcgtctcgtcgcagtggggcttcacgggcccctcctttacgatcaccgagggcaacaactccgtctaccgctgcgccgagctcggcaagtacctcctcgagaccggcgaggtcgatggcgtcgtcgttgcgggtgtcgatctctgcggcagtgccgaaaacctttacgtcaagtctcgccgcttcaaggtgtccacctccgataccccgcgcgccagctttgacgccgccgccgatggctactttgtcggcgagggctgcggtgcctttgtgctcaagcgtgagactagctgcaccaaggacgaccgtatctacgcttgcatggatgccatcgtccctggcaacgtccctagcgcctgcttgcgcgaggccctcgaccaggcgcgcgtcaagccgggcgatatcgagatgctcgagctcagcgccgactccgcccgccacctcaaggacccgtccgtcctgcccaaggagctcactgccgaggaggaaatcggcggccttcagacgatccttcgtgacgatgacaagctcccgcgcaacgtcgcaacgggcagtgtcaaggccaccgtcggtgacaccggttatgcctctggtgctgccagcctcatcaaggctgcgctttgcatctacaaccgctacctgcccagcaacggcgacgactgggatgaacccgcccctgaggcgccctgggacagcaccctctttgcgtgccagacctcgcgcgcttggctcaagaaccctggcgagcgtcgctatgcggccgtctcgggcgtctccgagacgcgctcgtgctattccgtgctcctctccgaagccgagggccactacgagcgcgagaaccgcatctcgctcgacgaggaggcgcccaagctcattgtgcttcgcgccgactcccacgaggagatccttggtcgcctcgacaagatccgcgagcgcttcttgcagcccacgggcgccgccccgcgcgagtccgagctcaaggcgcaggcccgccgcatcttcctcgagctcctcggcgagacccttgcccaggatgccgcttcttcaggctcgcaaaagcccctcgctctcagcctcgtctccacgccctccaagctccagcgcgaggtcgagctcgcggccaagggtatcccgcgctgcctcaagatgcgccgcgattggagctcccctgctggcagccgctacgcgcctgagccgctcgccagcgaccgcgtcgccttcatgtacggcgaaggtcgcagcccttactacggcatcacccaagacattcaccgcatttggcccgaactccacgaggtcatcaacgaaaagacgaaccgtctctgggccgaaggcgaccgctgggtcatgccgcgcgccagcttcaagtcggagctcgagagccagcagcaagagtttgatcgcaacatgattgaaatgttccgtcttggaatcctcacctcaattgccttcaccaatctggcgcgcgacgttctcaacatcacgcccaaggccgcctttggcctcagtcttggcgagatttccatgatttttgccttttccaagaagaacggtctcatctccgaccagctcaccaaggatcttcgcgagtccgacgtgtggaacaaggctctggccgttgaatttaatgcgctgcgcgaggcctggggcattccacagagtgtccccaaggacgagttctggcaaggctacattgtgcgcggcaccaagcaggatatcgaggcggccatcgccccggacagcaagtacgtgcgcctcaccatcatcaatgatgccaacaccgccctcattagcggcaagcccgacgcctgcaaggctgcgatcgcgcgtctcggtggcaacattcctgcgcttcccgtgacccagggcatgtgcggccactgccccgaggtgggaccttataccaaggatatcgccaagatccatgccaaccttgagttccccgttgtcgacggccttgacctctggaccacaatcaaccagaagcgcctcgtgccacgcgccacgggcgccaaggacgaatgggccccttcttcctttggcgagtacgccggccagctctacgagaagcaggctaacttcccccaaatcgtcgagaccatttacaagcaaaactacgacgtctttgtcgaggttgggcccaacaaccaccgtagcaccgcagtgcgcaccacgcttggtccccagcgcaaccaccttgctggcgccatcgacaagcagaacgaggatgcttggacgaccatcgtcaagcttgtggcttcgctcaaggcccaccttgttcctggcgtcacgatctcgccgctgtaccactccaagcttgtggcggaggctgaggcttgctacgctgcgctctgcaagggtgaaaagcccaagaagaacaagtttgtgcgcaagattcagctcaacggtcgcttcaacagcaaggcggaccccatctcctcggccgatcttgccagctttccgcctgcggaccctgccattgaagccgccatctcgagccgcatcatgaagccggttgctccgaagttctacgcgcgtctcaacattgacgagcaggacgagacccgtgatccgatcctcaacaaggacaacgcgccgtcttccagctctagctcctcttccagctcttccagctcttccagcccgtcgccagctccgtccgccccagtgcaaaagaaggctgctccggccgcggagaccaaggctgttgcttcggctgacgcacttcgcagtgccctgctcgatctcgacagtatgcttgcgctgagctctgccagtgcctccggcaaccttgttgagactgcgcctagcgacgcctcggtcattgtgccgccctgcaacattgcggatctcggcagccgcgccttcatgaaaacgtacggtgtttcggcgcctctgtacacgggcgccatggccaagggcattgcctctgcggacctcgtcattgccgccggccgccagggcatccttgcgtcctttggcgccggcggacttcccatgcaggttgtgcgtgagtccatcgaaaagattcaggccgccctgcccaatggcccgtacgctgtcaaccttatccattctccctttgacagcaacctcgaaaagggcaatgtcgatctcttcctcgagaagggtgtcacctttgtcgaggcctcggcctttatgacgctcaccccgcaggtcgtgcggtaccgcgcggctggcctcacgcgcaacgccgacggctcggtcaacatccgcaaccgtatcattggcaaggtctcgcgcaccgagctcgccgagatgttcatgcgtcctgcgcccgagcaccttcttcagaagctcattgcttccggcgagatcaaccaggagcaggccgagctcgcccgccgtgttcccgtcgctgacgacatcgcggtcgaagctgactcgggtggccacaccgacaaccgccccatccacgtcattctgcccctcatcatcaaccttcgcgaccgccttcaccgcgagtgcggctacccggccaaccttcgcgtccgtgtgggcgccggcggtggcattgggtgcccccaggcggcgctggccaccttcaacatgggtgcctcctttattgtcaccggcaccgtgaaccaggtcgccaagcagtcgggcacgtgcgacaatgtgcgcaagcagctcgcgaaggccacttactcggacgtatgcatggccccggctgccgacatgttcgaggaaggcgtcaagcttcaggtcctcaagaagggaaccatgtttccctcgcgcgccaacaagctctacgagctcttttgcaagtacgactcgttcgagtccatgccccccgcagagcttgcgcgcgtcgagaagcgcatcttcagccgcgcgctcgaagaggtctgggacgagaccaaaaacttttacattaaccgtcttcacaacccggagaagatccagcgcgccgagcgcgaccccaagctcaagatgtcgctgtgctttcgctggtacctgagcctggcgagccgctgggccaacactggagcttccgatcgcgtcatggactaccaggtctggtgcggtcctgccattggttccttcaacgatttcatcaagggaacttaccttgatccggccgtcgcaaacgagtacccgtgcgtcgttcagattaacaagcagatccttcgtggagcgtgcttcttgcgccgtctcgaaattctgcgcaacgcacgcctttccgatggcgctgccgctcttgtggccagcatcgatgacacatacgtcccggccgagaagctgtaagcggccgcatttaaatggatccactaggccatggtgacttaaggtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctagctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaacatatggcgctccgtgtcaagacgaacaagaagccatgctgggagatgaccaaggaggagctgaccagcggcaagaccgaggtgttcaactatgaggaactcctcgagttcgcagagggcgacatcgccaaggtcttcggacccgagttcgccgtcatcgacaagtacccgcgccgcgtgcgcctgcccgcccgcgagtacctgctcgtgacccgcgtcaccctcatggacgccgaggtcaacaactaccgcgtcggcgcccgcatggtcaccgagtacgatctccccgtcaacggagagctctccgagggcggagactgcccctgggccgtcctggtcgagagtggccagtgcgatctcatgctcatctcctacatgggcattgacttccagaaccagggcgaccgcgtctaccgcctgctcaacaccacgctcaccttttacggcgtggcccacgagggcgagaccctcgagtacgacattcgcgtcaccggcttcgccaagcgtctcgacggcggcatctccatgttcttcttcgagtacgactgctacgtcaacggccgcctcctcatcgagatgcgcgatggctgcgccggcttcttcaccaacgaggagctcgacgccggcaagggcgtcgtcttcacccgcggcgacctcgccgcccgcgccaagatcccaaagcaggacgtctccccctacgccgtcgccccctgcctccacaagaccaagctcaacgaaaaggagatgcagaccctcgtcgacaaggactgggcatccgtctttggctccaagaacggcatgccggaaatcaactacaaactctgcgcgcgtaagatgctcatgattgaccgcgtcaccagcattgaccacaagggcggtgtctacggcctcggtcagctcgtcggtgaaaagatcctcgagcgcgaccactggtactttccctgccactttgtcaaggatcaggtcatggccggatccctcgtctccgacggctgcagccagatgctcaagatgtacatgatctggctcggcctccacctcaccaccggaccctttgacttccgcccggtcaacggccaccccaacaaggtccgctgccgcggccaaatctccccgcacaagggcaagctcgtctacgtcatggagatcaaggagatgggcttcgacgaggacaacgacccgtacgccattgccgacgtcaacatcattgatgtcgacttcgaaaagggccaggactttagcctcgaccgcatcagcgactacggcaagggcgacctcaacaagaagatcgtcgtcgactttaagggcatcgctctcaagatgcagaagcgctccaccaacaagaacccctccaaggttcagcccgtctttgccaacggcgccgccactgtcggccccgaggcctccaaggcttcctccggcgccagcgccagcgccagcgccgccccggccaagcctgccttcagcgccgatgttcttgcgcccaagcccgttgcccttcccgagcacatcctcaagggcgacgccctcgcccccaaggagatgtcctggcaccccatggcccgcatcccgggcaacccgacgccctcttttgcgccctcggcctacaagccgcgcaacatcgcctttacgcccttccccggcaaccccaacgataacgaccacaccccgggcaagatgccgctcacctggttcaacatggccgagttcatggccggcaaggtcagcatgtgcctcggccccgagttcgccaagttcgacgactcgaacaccagccgcagccccgcttgggacctcgctctcgtcacccgcgccgtgtctgtgtctgacctcaagcacgtcaactaccgcaacatcgacctcgacccctccaagggtaccatggtcggcgagttcgactgccccgcggacgcctggttctacaagggcgcctgcaacgatgcccacatgccgtactcgatcctcatggagatcgccctccagacctcgggtgtgctcacctcggtgctcaaggcgcccctgaccatggagaaggacgacatcctcttccgcaacctcgacgccaacgccgagttcgtgcgcgccgacctcgactaccgcggcaagactatccgcaacgtcaccaagtgcactggctacagcatgctcggcgagatgggcgtccaccgcttcacctttgagctctacgtcgatgatgtgctcttttacaagggctcgacctcgttcggctggttcgtgcccgaggtctttgccgcccaggccggcctcgacaacggccgcaagtcggagccctggttcattgagaacaaggttccggcctcgcaggtctcctcctttgacgtgcgccccaacggcagcggccgcaccgccatcttcgccaacgcccccagcggcgcccagctcaaccgccgcacggaccagggccagtacctcgacgccgtcgacattgtctccggcagcggcaagaagagcctcggctacgcccacggttccaagacggtcaacccgaacgactggttcttctcgtgccacttttggtttgactcggtcatgcccggaagtctcggtgtcgagtccatgttccagctcgtcgaggccatcgccgcccacgaggatctcgctggcaagcacggcattgccaaccccacctttgtgcacgccccgggcaagatcagctggaagtaccgcggccagctcacgcccaagagcaagaagatggactcggaggtccacatcgtgtccgtggacgcccacgacggcgttgtcgacctcgtcgccgacggcttcctctgggccgacagcctccgcgtctactcggtgagcaacattcgcgtgcgcatcgcctccggtgaggcccctgccgccgcctcctccgccgcctctgtgggctcctcggcttcgtccgtcgagcgcacgcgctcgagccccgctgtcgcctccggcccggcccagaccatcgacctcaagcagctcaagaccgagctcctcgagctcgatgccccgctctacctctcgcaggacccgaccagcggccagctcaagaagcacaccgacgtggcctccggccaggccaccatcgtgcagccctgcacgctcggcgacctcggtgaccgctccttcatggagacctacggcgtcgtcgccccgctgtacacgggcgccatggccaagggcattgcctcggcggacctcgtcatcgccgccggcaagcgcaagatcctcggctcctttggcgccggcggcctccccatgcaccacgtgcgcgccgccctcgagaagatccaggccgccctgcctcagggcccctacgccgtcaacctcatccactcgccttttgacagcaacctcgagaagggcaacgtcgatctcttcctcgagaagggcgtcactgtggtggaggcctcggcattcatgaccctcaccccgcaggtcgtgcgctaccgcgccgccggcctctcgcgcaacgccgacggttcggtcaacatccgcaaccgcatcatcggcaaggtctcgcgcaccgagctcgccgagatgttcatccgcccggccccggagcacctcctcgagaagctcatcgcctcgggcgagatcacccaggagcaggccgagctcgcgcgccgcgttcccgtcgccgacgatatcgctgtcgaggctgactcgggcggccacaccgacaaccgccccatccacgtcatcctcccgctcatcatcaacctccgcaaccgcctgcaccgcgagtgcggctaccccgcgcacctccgcgtccgcgttggcgccggcggtggcgtcggctgcccgcaggccgccgccgccgcgctcaccatgggcgccgccttcatcgtcaccggcactgtcaaccaggtcgccaagcagtccggcacctgcgacaacgtgcgcaagcagctctcgcaggccacctactcggatatctgcatggccccggccgccgacatgttcgaggagggcgtcaagctccaggtcctcaagaagggaaccatgttcccctcgcgcgccaacaagctctacgagctcttttgcaagtacgactccttcgactccatgcctcctgccgagctcgagcgcatcgagaagcgtatcttcaagcgcgcactccaggaggtctgggaggagaccaaggacttttacattaacggtctcaagaacccggagaagatccagcgcgccgagcacgaccccaagctcaagatgtcgctctgcttccgctggtaccttggtcttgccagccgctgggccaacatgggcgccccggaccgcgtcatggactaccaggtctggtgtggcccggccattggcgccttcaacgacttcatcaagggcacctacctcgaccccgctgtctccaacgagtacccctgtgtcgtccagatcaacctgcaaatcctccgtggtgcctgctacctgcgccgtctcaacgccctgcgcaacgacccgcgcattgacctcgagaccgaggatgctgcctttgtctacgagcccaccaacgcgctctaagctagcatttaaatctaggccatggtgacttaaggtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgttgcagcatacttggctaccaaaacccccaaatttaaccttattgtcagatgaagttcatctctggcgcattccccttgaccaaccagaatcacagctacaggatttagccgctaccttatctagtgacgaattagcccgtgcaaacagattttattttcccgaacatcgccggcgttttactgctggtcgtggtattctccgcagtatcttggggggctatttgggtgtggaaccagggcaagttaaatttgattatgaatcccgtggtaaaccaatattaggcgatcgctttgccgagagtggtttattatttaacttgtcacactcccagaacttggccttgtgtgcagtcaattacacgcgccaaatcggcatcgatttagaatatctccgccccacatctgatttagaatcccttgccaaaaggttctttttaccgcgagaatatgaattattgcgatcgctacccgatgagcaaaaacaaaaaattttctttcgttactggacttgtaaagaggcttatcttaaagcaacgggtgacggcatcgctaaattagaggaaattgaaatagcactaactcccacagaaccagctaagttacagacagctccagcgtggagtctcctagagctagtgccagatgataattgtgttgctgctgttgccgtggcgggttttggctggcagccaaaattctggcattattgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagctttc

SEQ ID NO: 35 - DNA, 35154 bp, Artificial sequence
  plasmid pDAB7369
ttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagctttc

SEQ ID NO: 36 - DNA, 36102 bp, Artificial sequence
  plasmid pDAB7370
ttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaagcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaagctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaagcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaacttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagctttc

SEQ ID NO: 37 - DNA, 39183 bp, Artificial sequence
  plasmid pDAB100518
ttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttaagctctcttgtaacgttaccaatcatcttcacacattctcattctttagcgattctagtctgttcatccctgtcaacagaaggactcttgctgtgtctatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttaagctctcttgtaacgttaccaatcatcttcacacattctcattctttagcgattctagtctgttcatccctgtcaacagaaggactcttgctgtgtctatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttaagctctcttgtaacgttaccaatcatcttcacacattctcattctttagcgattctagtctgttcatccctgtcaacagaaggactcttgctgtgtctatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggcgagtcatgagtcgtgacatgacgtcatgctcatcagactgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcccactccagatgccactgcgcctctcaacaagccgtcagactatgctgtgtaccacgaagaggatggtcctttctggactgctgattcctctggtgtcagcagagtgaacttctctgaaactggtgtgggatctgaaggtgtcattcctgcgctcacactgattgatgtgtttgagcgtgcggtcaaacgtggtggcaataggattgcattcagaacagagaacatgccaaccttgaggcgtggagaagaggctcctgatgctttgccgctcaaagattggaagtcctggtcttggaaacagtacaaagctgatgttcacagaattgcgagggctctgatggatttgggagttgagcagcacgatgcggtctccatctttggcttcaactcaccagaatggttcctcagtgctgtcggtgcagttcatgctggtgccaagatcgctggaatctacccttcagacactcctgctcaagtgcagtacaaagccttccactctgacactgctgttgcagttgtggagaacgaacagtgcttcaagaaattcgcagaggtggttgaggatctcccttacctcaaagccattgtttgttgggattatgaagccacagacatcacaagggaagatggttcagtggttgaagtcctgacctttgctgagttcctgaagagaggtgacactgtggaagcagctgcacttgatgagagaatcagcaagattgagcccaccatgtgtgctgccctgatctacaccagtggcacaactgggagacccaaagctgtcatgatctcccatgacaaccttgtctttgaagcatctgctgtggtcccgaacttgggaggggcatgcacgaccactgctgaggaaaggattctttcctaccttcctttgtctcatgttgctggaatgatggttgacatcattgctccaatcatagcgacagcgttccacaaaggaaggatctgtgtttgttttgccagaccgtatgatttgagaactggaacccttgggcaaagactcaatgcagtggagccaaccatattccttggtgtgccacgtgtgtgggaaaagatccaagagaaattgatggctgttggtgccaaaaccactggtctcaagaagaaactcagcacggcagccaagaaacgtgggcttgaatttcaagaggaacaacagatagggagaagtggtgccaaccctggctttggaccgcttggaatctacaagaaacttttgggcctcatcaaaggaaagttggggctgaccaaatgcaagtttgcctttgctggcgcagctccaatgacccgtgaaacccttcagtactttggagcgctgaacatcaacatcaatgaggtctatggaatgtctgaatgcagtggggctgccacctggtcaactgacaaagctcatgagtggggcactgttggctatgagatgccctcctgtgaagtcagagtgttcaagattgcggaggatggcaccaagacagagtgcccaagagctgctgacatcatgcatgccacagaagaggaacaaggtgaagtttgcttccgtggaaggaacatcatgatgggatacttggccaacccgaaacttggtgatgaccatgttgctgagattgaagagaagaatgcagctgccatagatagcgaagggtggcttcactctggtgacaagggagcaatttccacaaggggaatgctcaagataacgggcagatacaaggagcttatcataggtgctggtggggagaatgtggctcctgttcccattgaagatgccatcaaggcgaggatgccttttgtttcaaatgcaatgatggttggagacaagaggaagttcatggctgtccttctgactttgaaaacggttggagcaactggagagcttcctggcacaaacaagctcatgggagcagctgcggactatggtgagaccattgaggatgcctgtgacaatgaggcgctcattgaagagataacgcagcaactcaaagagataggtgacgatggagatgtcacgccaagcaatgcagcccgtatacaaaagttcacgattttgccactcgacttcagtgtctccacagatgaactgacagcaacgttgaaattgaagagaagtgtggttgcagacaagtatgaggacatcatagaggctttctatgagagcaagtctgtctttgtgccttactcaacagttggagcttatgcaacgggtggaccagttgatgactctgttgtggatggatcattcaaaggtgactttagcatgattggggatgacgatccggatcttcagaatgtggatgtccttgaagcaattgatgaggacaactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgatcatggatgctacgtcacggcagtacaggactatcactagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttaagctctcttgtaacgttaccaatcatcttcacacattctcattctttagcgattctagtctgttcatccctgtcaacagaaggactcttgctgtgtctatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagctttc

SEQ ID NO: 38 - DNA, 38742 bp, Artificial sequence
  plasmid pDAB101476
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggcgagtcatgagtcgtgacatgacgtcatgctcatcagactgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaacctaccatggctcccactcccgacgccaccgcgcctctgaacaagccgagcgactatgccgtctaccacgaggaagacggccccttctggaccgccgattccagcggcgtctcgcgcgtgaactttagcgagaccggcgtgggatccgagggcgtcatccctgcgctcacgctcatcgacgtcttcgagagggccgtcaagcgcggcggaaacaggatcgccttccgcacggaaaacatgcccacgctccgccgcggcgaagaggccccggacgcgctgccgctcaaggactggaagtcctggtcctggaaacagtacaaggccgacgtccaccgcatcgccagggctctcatggacctcggcgttgagcagcatgacgccgtctccatttttggctttaactcgcccgaatggtttctcagtgccgtcggcgccgtgcacgcaggtgccaagattgccggcatttacccctcagacacgcccgcccaggtccagtacaaggccttccacagtgacaccgctgttgccgttgtcgaaaacgagcagtgcttcaagaagttcgccgaggtcgtcgaggaccttccttacctcaaggccattgtttgctgggactatgaagccacagacatcacgcgcgaggacggctccgtcgtcgaggtcctcacctttgccgagttcctcaagcgcggcgacaccgtcgaggcggccgcccttgacgagcgcatctccaagatcgagcccaccatgtgcgctgcccttatttacaccagcggtactaccggccgccccaaggccgttatgatttcgcacgacaaccttgttttcgaggccagcgccgtcgtccccaacctcggaggagcctgtacgaccactgctgaggagcgcattctctcgtacctgcctctctcgcacgtcgctggtatgatggttgatattattgcccccatcattgccaccgccttccacaagggccgcatctgcgtctgctttgctcgcccgtacgatttgcgcaccggcacgctgggccagcgcctcaacgccgtggagcccaccatcttccttggcgtgccccgtgtgtgggaaaagattcaggaaaagctcatggccgtcggtgccaaaaccaccggcctcaagaagaagctctctacggccgccaagaagcgtggtcttgaattccaggaggagcagcaaatcggccgctccggtgccaaccctggctttggcccccttggcatctacaagaagctcctcggcctcatcaagggcaagctgggcctcaccaagtgcaagtttgcctttgctggtgccgcgcccatgacccgtgagacccttcagtactttggcgcgctgaacatcaacattaacgaggtctacggcatgtccgagtgctccggtgccgccacctggtccacggacaaggcccacgagtggggcactgttggctacgagatgcccagttgcgaggtccgcgtcttcaagattgccgaggacggtaccaagaccgagtgcccgcgcgccgccgacattatgcatgctaccgaggaggagcagggcgaagtttgcttccgcggccgtaacatcatgatgggctaccttgccaaccccaagcttggcgacgaccacgttgccgagatcgaggagaagaacgctgccgctatcgactccgagggctggctccacagtggtgataagggcgccatttctacccgcggcatgctcaagatcacgggccgctacaaggagctcatcatcggcgccggtggcgagaacgtggcgcccgtccctattgaggacgccatcaaggcgcgcatgccttttgtttccaacgccatgatggtcggagataagcgcaagttcatggctgtcctccttaccctcaagacggttggcgccacgggcgagcttcccggtacgaacaagctcatgggcgctgccgccgactatggtgagaccatcgaggacgcctgcgacaacgaggcgctcattgaggagatcacgcagcagctcaaggagatcggtgatgatggcgatgtcacgccctcgaacgcggctcgcatccaaaagttcaccattctcccgctcgacttttccgtctccacggacgagctcacggccacgctcaagctcaagcgctccgtggtcgcagacaagtacgaagacatcatcgaggccttttacgagtccaagagcgtttttgtgccgtactcgaccgttggcgcctacgccacgggcggcccggtcgacgactccgttgtcgatggctccttcaagggcgactttagcatgattggcgacgatgatccggatcttcaaaacgtcgatgtcctcgaggcgattgacgaggacaattaaatttccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgatcatggatgctacgtcacggcagtacaggactatccctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 39 - DNA, 38760 bp, Artificial sequence
  plasmid pDAB101477
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggcgagtcatgagtcgtgacatgacgtcatgctcatcagactgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggctcccactcccgacgccaccgcgcctctgaacaagccgagcgactatgccgtctaccacgaggaagacggccccttctggaccgccgattccagcggcgtctcgcgcgtgaactttagcgagaccggcgtgggatccgagggcgtcatccctgcgctcacgctcatcgacgtcttcgagagggccgtcaagcgcggcggaaacaggatcgccttccgcacggaaaacatgcccacgctccgccgcggcgaagaggccccggacgcgctgccgctcaaggactggaagtcctggtcctggaaacagtacaaggccgacgtccaccgcatcgccagggctctcatggacctcggcgttgagcagcacgacgccgtctcgatttttggctttaactcgcccgaatggtttctcagtgccgtcggcgccgtgcacgcaggtgccaagattgccggtatttacccctcagacacgcccgcccaggtccagtacaaggccttccacagtgacaccgctgttgccgttgtcgaaaacgagcagtgcttcaagaagttcgccgaggtcgtcgaggaccttccttacctcaaggccattgtttgctgggactatgaagccacagacatcacgcgcgaggacggctccgtcgtcgaggtcctcacctttgccgagttcctcaagcgcggcgacaccgtcgaggcggccgcccttgacgagcgcatctccaagatcgagcccaccatgtgcgctgcccttatttacaccagcggtactaccggccgccccaaggccgttatgatttcgcacgacaaccttgttttcgaggccagcgccgtcgtccccaacctcggaggagcctgtacgaccactgctgaggagcgcattctctcgtacctgcctctctcgcacgtcgctggtatgatggttgatattattgcccccatcattgccaccgccttccacaagggccgcatctgcgtctgctttgctcgcccgtacgatttgcgcaccggcacgctgggccagcgcctcaacgccgtggagcccaccatcttccttggcgtgccccgtgtgtgggaaaagattcaggaaaagctcatggccgtcggtgccaaaaccaccggcctcaagaagaagctctctacggccgccaagaagcgtggtcttgaattccaggaggagcagcaaatcggccgctccggtgccaaccctggctttggcccccttggcatctacaagaagctcctcggcctcatcaagggcaagctgggcctcaccaagtgcaagtttgcctttgctggtgccgcgcccatgacccgtgagacccttcagtactttggcgcgctgaacatcaacattaacgaggtctacggcatgtcagagtgctccggtgccgccacctggtccacggacaaggcccacgagtggggcactgttggctacgagatgcccagttgcgaggtccgcgtcttcaagattgccgaggacggtaccaagaccgagtgcccgcgcgccgccgacattatgcatgctaccgaggaggagcagggcgaagtttgcttccgcggccgtaacatcatgatgggctaccttgccaaccccaagcttggcgacgaccacgttgccgagatcgaggagaagaacgctgccgctatcgactccgagggctggctccacagtggtgataagggcgccatttctacccgcggcatgctcaagatcacgggccgctacaaggagctcatcatcggcgccggtggcgagaacgtggcgcccgtccctattgaggacgccatcaaggcgcgcatgccttttgtttccaacgccatgatggtcggagataagcgcaagttcatggctgtcctccttaccctcaagacggttggcgccacgggcgagcttcccggtacgaacaagctcatgggcgctgccgccgactacggtgagaccatcgaggacgcctgcgacaacgaggcgctcattgaggagatcacgcagcagctcaaggagatcggtgatgatggcgatgtcacgccctcgaacgcggctcgcatccaaaagttcaccattctcccgctcgacttttccgtctccacggacgagctcacggccacgctcaagctcaagcgctccgtggtcgcagacaagtacgaagacatcatcgaggccttttacgagtccaagagcgtttttgtgccgtactcgaccgttggcgcctacgccacgggcggcccggtcgacgactccgttgtcgatggctcattcaagggcgactttagcatgattggcgacgatgatccggatcttcaaaacgtcgatgtcctcgaggcgattgacgaggacaattaagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgatcatggatgctacgtcacggcagtacaggactatccctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 40 - DNA, 34862 bp, Artificial sequence
  plasmid pDAB9166
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcgaattcggaaatgggccaagtgaaatggaaatagagcttcaatccatttagtcccactcaaaatggtgctcgaattatatttagttacgttcgaatcagacaaccaagtatttggttaataaaaaccactcgcaacaaaggaaaaacaccaagcgcgtgcgtccaacatccgacggaaggggggtaatgtggtccgaaaaccttacaaaaatctgacgtcatctacccccgaaaacgttgaatcgtcaacgggggtagttttcgaattatcttttttttaggggcagttttattaatttgctctagaaattttatgattttaattaaaaaaagaaaaagaatatttgtatatttattttttatactctttttttgtccaactatttctcttattttggcaactttaactagactagtaacttatgtcaatgtgtatggatgcatgagagtgagtatacacatgtctaaatgcatgccttatgaaagcaacgcaccacaaaacgaagacccctttacaaatacatctcatcccttagtaccctcttactactgtcccgacacaaactcaaaacaaggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcaccctatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcgaattcggaaatgggccaagtgaaatggaaatagagcttcaatccatttagtcccactcaaaatggtgctcgaattatatttagttacgttcgaatcagacaaccaagtatttggttaataaaaaccactcgcaacaaaggaaaaacaccaagcgcgtgcgtccaacatccgacggaaggggggtaatgtggtccgaaaaccttacaaaaatctgacgtcatctacccccgaaaacgttgaatcgtcaacgggggtagttttcgaattatcttttttttaggggcagttttattaatttgctctagaaattttatgattttaattaaaaaaagaaaaagaatatttgtatatttattttttatactctttttttgtccaactatttctcttattttggcaactttaactagactagtaacttatgtcaatgtgtatggatgcatgagagtgagtatacacatgtctaaatgcatgccttatgaaagcaacgcaccacaaaacgaagacccctttacaaatacatctcatcccttagtaccctcttactactgtcccgacacaaactcaaaacaaggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcaccctatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcgcggccgcgaattcggaaatgggccaagtgaaatggaaatagagcttcaatccatttagtcccactcaaaatggtgctcgaattatatttagttacgttcgaatcagacaaccaagtatttggttaataaaaaccactcgcaacaaaggaaaaacaccaagcgcgtgcgtccaacatccgacggaaggggggtaatgtggtccgaaaaccttacaaaaatctgacgtcatctacccccgaaaacgttgaatcgtcaacgggggtagttttcgaattatcttttttttaggggcagttttattaatttgctctagaaattttatgattttaattaaaaaaagaaaaagaatatttgtatatttattttttatactctttttttgtccaactatttctcttattttggcaactttaactagactagtaacttatgtcaatgtgtatggatgcatgagagtgagtatacacatgtctaaatgcatgccttatgaaagcaacgcaccacaaaacgaagacccctttacaaatacatctcatcccttagtaccctcttactactgtcccgacacaaactcaaaacaaggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcaccctatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcgaattcggaaatgggccaagtgaaatggaaatagagcttcaatccatttagtcccactcaaaatggtgctcgaattatatttagttacgttcgaatcagacaaccaagtatttggttaataaaaaccactcgcaacaaaggaaaaacaccaagcgcgtgcgtccaacatccgacggaaggggggtaatgtggtccgaaaaccttacaaaaatctgacgtcatctacccccgaaaacgttgaatcgtcaacgggggtagttttcgaattatcttttttttaggggcagttttattaatttgctctagaaattttatgattttaattaaaaaaagaaaaagaatatttgtatatttattttttatactctttttttgtccaactatttctcttattttggcaactttaactagactagtaacttatgtcaatgtgtatggatgcatgagagtgagtatacacatgtctaaatgcatgccttatgaaagcaacgcaccacaaaacgaagacccctttacaaatacatctcatcccttagtaccctcttactactgtcccgacacaaactcaaaacaaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcaccctatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 41 - DNA, 34404 bp, Artificial sequence
  plasmid pDAB9167
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcgaattcggaaatgggccaagtgaaatggaaatagagcttcaatccatttagtcccactcaaaatggtgctcgaattatatttagttacgttcgaatcagacaaccaagtatttggttaataaaaaccactcgcaacaaaggaaaaacaccaagcgcgtgcgtccaacatccgacggaaggggggtaatgtggtccgaaaaccttacaaaaatctgacgtcatctacccccgaaaacgttgaatcgtcaacgggggtagttttcgaattatcttttttttaggggcagttttattaatttgctctagaaattttatgattttaattaaaaaaagaaaaagaatatttgtatatttattttttatactctttttttgtccaactatttctcttattttggcaactttaactagactagtaacttatgtcaatgtgtatggatgcatgagagtgagtatacacatgtctaaatgcatgccttatgaaagcaacgcaccacaaaacgaagacccctttacaaatacatctcatcccttagtaccctcttactactgtcccgacacaaactcaaaacaaggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcaccctatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcagatctgattggtaagatatgggtactgtttggtttatatgttttgactattcagtcactatggcccccataaattttaattcggctggtatgtctcggttaagaccggtttgacatggttcatttcagttcaattatgttaatctggcacgtgatatgtttaccttcacacgaacattagtaatgatgggctaatttaagacttaacaggcctagagaggcccatcttattacgtaacggcgtcgtttagagtgcaccaagcttataaatgaaaacgagctacctcgggacatcacgctctttgtacactccgccatctctctctctcgttggagcagatctctctcgtgaatatcgacaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcaccctatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcgcggccgcgaattcggaaatgggccaagtgaaatggaaatagagcttcaatccatttagtcccactcaaaatggtgctcgaattatatttagttacgttcgaatcagacaaccaagtatttggttaataaaaaccactcgcaacaaaggaaaaacaccaagcgcgtgcgtccaacatccgacggaaggggggtaatgtggtccgaaaaccttacaaaaatctgacgtcatctacccccgaaaacgttgaatcgtcaacgggggtagttttcgaattatcttttttttaggggcagttttattaatttgctctagaaattttatgattttaattaaaaaaagaaaaagaatatttgtatatttattttttatactctttttttgtccaactatttctcttattttggcaactttaactagactagtaacttatgtcaatgtgtatggatgcatgagagtgagtatacacatgtctaaatgcatgccttatgaaagcaacgcaccacaaaacgaagacccctttacaaatacatctcatcccttagtaccctcttactactgtcccgacacaaactcaaaacaaggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcaccctatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcagatctgattggtaagatatgggtactgtttggtttatatgttttgactattcagtcactatggcccccataaattttaattcggctggtatgtctcggttaagaccggtttgacatggttcatttcagttcaattatgttaatctggcacgtgatatgtttaccttcacacgaacattagtaatgatgggctaatttaagacttaacaggcctagagaggcccatcttattacgtaacggcgtcgtttagagtgcaccaagcttataaatgaaaacgagctacctcgggacatcacgctctttgtacactccgccatctctctctctcgttggagcagatctctctcgtgaatatcgacaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcaccctatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 42 - DNA, 38762 bp, Artificial sequence
  plasmid pDAB7379
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaactactgtcactgaggccgtagacgagtacggactgatctaactagtgctagcctcgaggtcgacacccagcttt

SEQ ID NO: 43 - DNA, 35836 bp, Artificial sequence
  plasmid pDAB7380
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaagatgagtgatactcaggactcaggactcactctgctgatcactagtgctagcctcgaggtcgacacaactttgtatacaaaagttgtctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaatctgacctgaccactagacctgagtgagtacagatgtgctactagtgctagcctcgaggtcgaccaacttttctatacaaagttgtctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaatcacgagtggatgactgtcacgactgactcatgactgactactagtgctagcctcgaggtcgacacaactttgtataataaagttgtctagtctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaactactgtcactgaggccgtagacgagtacggactgatctaactagtgctagcctcgaggtcgacacccagcttt

SEQ ID NO: 44 - DNA, 47165 bp, Artificial sequence
  plasmid pDAB9323
gtacaaaaaagcaggcttctagacctagctaggtggagtcatcacgcagactatctcagcatgtgcgtagcacgcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcggcccgtctgcaggagcaaaagggaggcgagatggatacccgcattgccatcatcggcatgtcggccatcctcccctgcggcacgaccgtgcgcgagtcgtgggagaccatccgcgccggcatcgactgcctgtcggatctccccgaggaccgcgtcgacgtgacggcgtactttgaccccgtcaagaccaccaaggacaagatctactgcaagcgcggtggcttcattcccgagtacgactttgacgcccgcgagttcggactcaacatgttccagatggaggactcggacgcaaaccagaccatctcgcttctcaaggtcaaggaggccctccaggacgccggcatcgacgccctcggcaaggaaaagaagaacatcggctgcgtgctcggcattggcggcggccaaaagtccagccacgagttctactcgcgccttaattatgttgtcgtggagaaggtcctccgcaagatgggcatgcccgaggaggacgtcaaggtcgccgtcgaaaagtacaaggccaacttccccgagtggcgcctcgactccttccctggcttcctcggcaacgtcaccgccggtcgctgcaccaacaccttcaacctcgacggcatgaactgcgttgtcgacgccgcatgcgcctcgtccctcatcgccgtcaaggtcgccatcgacgagctgctctacggtgactgcgacatgatggtcaccggtgccacctgcacggataactccatcggcatgtacatggccttctccaagacccccgtgttctccacggaccccagcgtgcgcgcctacgacgaaaagacaaagggcatgctcatcggcgagggctccgccatgctcgtcctcaagcgctacgccgacgccgtccgcgacggcgatgagatccacgctgttattcgcggctgcgcctcctccagtgatggcaaggccgccggcatctacacgcccaccatttcgggccaggaggaggccctccgccgcgcctacaaccgcgcctgtgtcgacccggccaccgtcactctcgtcgagggtcacggcaccggtactcccgttggcgaccgcatcgagctcaccgccttgcgcaacctctttgacaaggcctacggcgagggcaacaccgaaaaggtcgctgtgggcagcatcaagtccagcatcggccatctcaaggccgtcgccggtctcgccggtatgatcaaggtcatcatggcgctcaagcacaagactctcccgggcaccatcaacgtcgacaacccacccaacctctacgacaacacgcccatcaacgagtcctcgctctacattaacaccatgaaccgcccctggttcccgccccctggtgtgccccgccgcgccggcatttcgagctttggctttggtggcgccaactaccacgccgtcctcgaggaggccgagcccgagcacacgaccgcgtaccgcctcaacaagcgcccgcagcccgtgctcatgatggccgccacgcccgcggccctccagtcgctctgcgaggcccagctcaaggagttcgaggccgccatcaaggagaacgagaccgtcaagaacaccgcctacatcaagtgcgtcaagttcggcgagcagttcaaattccctggctccatcccggccacaaacgcgcgcctcggcttcctcgtcaaggatgctgaggatgcctgctccaccctccgtgccatctgcgcccaattcgccaaggatgtcaccaaggaggcctggcgcctcccccgcgagggcgtcagcttccgcgccaagggcatcgccaccaacggcgctgtcgccgcgctcttctccggccagggcgcgcagtacacgcacatgtttagcgaggtggccatgaactggccccagttccgccagagcattgccgccatggacgccgcccagtccaaggtcgctggaagcgacaaggactttgagcgcgtctcccaggtcctctacccgcgcaagccgtacgagcgtgagcccgagcaggaccacaagaagatctccctcaccgcctactcgcagccctcgaccctggcctgcgctctcggtgcctttgagatcttcaaggaggccggcttcaccccggactttgccgccggccattcgctcggtgagttcgccgccctctacgccgcgggctgcgtcgaccgcgacgagctctttgagcttgtctgccgccgcgcccgcatcatgggcggcaaggacgcaccggccacccccaagggctgcatggccgccgtcattggccccaacgccgagaacatcaaggtccaggccgccaacgtctggctcggcaactccaactcgccttcgcagaccgtcatcaccggctccgtcgaaggtatccaggccgagagcgcccgcctccagaaggagggcttccgcgtcgtgcctcttgcctgcgagagcgccttccactcgccccagatggagaacgcctcgtcggccttcaaggacgtcatctccaaggtctccttccgcacccccaaggccgagaccaagctcttcagcaacgtctctggcgagacctaccccacggacgcccgcgagatgcttacgcagcacatgaccagcagcgtcaagttcctcacccaggtccgcaacatgcaccaggccggtgcgcgcatctttgtcgagttcggacccaagcaggtgctctccaagcttgtctccgagaccctcaaggatgacccctcggttgtcaccgtctctgtcaacccggcctcgggcacggattcggacatccagctccgcgacgcggccgtccagctcgttgtcgctggcgtcaaccttcagggctttgacaagtgggacgcccccgatgccacccgcatgcaggccatcaagaagaagcgcactaccctccgcctttcggccgccacctacgtctcggacaagaccaagaaggtccgcgacgccgccatgaacgatggccgctgcgtcacctacctcaagggcgccgcaccgctcatcaaggccccggagcccgttgtcgacgaggccgccaagcgcgaggccgagcgtctccagaaggagcttcaggatgcccagcgccagctcgacgacgccaagcgcgccgccgccgaggccaactccaagctcgccgctgccaaggaggaggccaagaccgccgctgcttcggccaagcccgcagttgacactgctgttgtcgaaaagcatcgtgccatcctcaagtccatgctcgcggagctcgatggctacggatcggtcgacgcttcttccctccagcagcagcagcagcagcagacggcccccgccccggtcaaggctgctgcgcctgccgcccccgttgcctcggcccctgccccggctgtctcgaacgagcttcttgagaaggccgagactgtcgtcatggaggtcctcgccgccaagaccggctacgagaccgacatgatcgaggctgacatggagctcgagaccgagctcggcattgactccatcaagcgtgtcgagatcctctccgaggtccaggccatgctcaatgtcgaggccaaggatgtcgatgccctcagccgcactcgcactgttggtgaggttgtcaacgccatgaaggccgagatcgctggcagctctgccccggcgcctgctgccgctgctccggctccggccaaggctgcccctgccgccgctgcgcctgctgtctcgaacgagcttctcgagaaggccgagaccgtcgtcatggaggtcctcgccgccaagactggctacgagactgacatgatcgagtccgacatggagctcgagactgagctcggcattgactccatcaagcgtgtcgagatcctctccgaggttcaggccatgctcaacgtcgaggccaaggacgtcgacgctctcagccgcactcgcactgtgggtgaggtcgtcaacgccatgaaggctgagatcgctggtggctctgccccggcgcctgccgccgctgccccaggtccggctgctgccgcccctgcgcctgccgccgccgcccctgctgtctcgaacgagcttcttgagaaggccgagaccgtcgtcatggaggtcctcgccgccaagactggctacgagactgacatgatcgagtccgacatggagctcgagaccgagctcggcattgactccatcaagcgtgtcgagattctctccgaggtccaggccatgctcaacgtcgaggccaaggacgtcgacgctctcagccgcacccgcactgttggcgaggtcgtcgatgccatgaaggccgagatcgctggtggctctgccccggcgcctgccgccgctgctcctgctccggctgctgccgcccctgcgcctgccgcccctgcgcctgctgtctcgagcgagcttctcgagaaggccgagactgtcgtcatggaggtcctcgccgccaagactggctacgagactgacatgatcgagtccgacatggagctcgagaccgagctcggcattgactccatcaagcgtgtcgagattctctccgaggtccaggccatgctcaacgtcgaggccaaggacgtcgacgctctcagccgcacccgcactgttggcgaggtcgtcgatgccatgaaggccgagatcgctggtggctctgccccggcgcctgccgccgctgctcctgctccggctgctgccgcccctgcgcctgccgcccctgcgcctgccgcccctgcgcctgctgtctcgagcgagcttctcgagaaggccgagactgtcgtcatggaggtcctcgccgccaagactggctacgagactgacatgattgagtccgacatggagctcgagaccgagctcggcattgactccatcaagcgtgtcgagattctctccgaggttcaggccatgctcaacgtcgaggccaaggacgtcgacgctctcagccgcactcgcactgttggtgaggtcgtcgatgccatgaaggctgagatcgctggcagctccgcctcggcgcctgccgccgctgctcctgctccggctgctgccgctcctgcgcccgctgccgccgcccctgctgtctcgaacgagcttctcgagaaagccgagactgtcgtcatggaggtcctcgccgccaagactggctacgagactgacatgatcgagtccgacatggagctcgagactgagctcggcattgactccatcaagcgtgtcgagatcctctccgaggttcaggccatgctcaacgtcgaggccaaggacgtcgatgccctcagccgcacccgcactgttggcgaggttgtcgatgccatgaaggccgagatcgctggtggctctgccccggcgcctgccgccgctgcccctgctccggctgccgccgcccctgctgtctcgaacgagcttctcgagaaggccgagactgtcgtcatggaggtcctcgccgccaagactggctacgagaccgacatgatcgagtccgacatggagctcgagaccgagctcggcattgactccatcaagcgtgtcgagattctctccgaggttcaggccatgctcaacgtcgaggccaaggacgtcgatgctctcagccgcactcgcactgttggcgaggtcgtcgatgccatgaaggctgagatcgccggcagctccgccccggcgcctgccgccgctgctcctgctccggctgctgccgctcctgcgcccgctgccgctgcccctgctgtctcgagcgagcttctcgagaaggccgagaccgtcgtcatggaggtcctcgccgccaagactggctacgagactgacatgattgagtccgacatggagctcgagactgagctcggcattgactccatcaagcgtgtcgagatcctctccgaggttcaggccatgctcaacgtcgaggccaaggacgtcgatgccctcagccgcacccgcactgttggcgaggttgtcgatgccatgaaggccgagatcgctggtggctctgccccggcgcctgccgccgctgcccctgctccggctgccgccgcccctgctgtctcgaacgagcttcttgagaaggccgagaccgtcgtcatggaggtcctcgccgccaagactggctacgagaccgacatgatcgagtccgacatggagctcgagaccgagctcggcattgactccatcaagcgtgtcgagattctctccgaggttcaggccatgctcaacgtcgaggccaaggacgtcgacgctctcagccgcactcgcactgttggcgaggtcgtcgatgccatgaaggctgagatcgctggtggctctgccccggcgcctgccgccgctgctcctgcctcggctggcgccgcgcctgcggtcaagattgactcggtccacggcgctgactgtgatgatctttccctgatgcacgccaaggtggttgacatccgccgcccggacgagctcatcctggagcgccccgagaaccgccccgttctcgttgtcgatgacggcagcgagctcaccctcgccctggtccgcgtcctcggcgcctgcgccgttgtcctgacctttgagggtctccagctcgctcagcgcgctggtgccgctgccatccgccacgtgctcgccaaggatctttccgcggagagcgccgagaaggccatcaaggaggccgagcagcgctttggcgctctcggcggcttcatctcgcagcaggcggagcgcttcgagcccgccgaaatcctcggcttcacgctcatgtgcgccaagttcgccaaggcttccctctgcacggctgtggctggcggccgcccggcctttatcggtgtggcgcgccttgacggccgcctcggattcacttcgcagggcacttctgacgcgctcaagcgtgcccagcgtggtgccatctttggcctctgcaagaccatcggcctcgagtggtccgagtctgacgtcttttcccgcggcgtggacattgctcagggcatgcaccccgaggatgccgccgtggcgattgtgcgcgagatggcgtgcgctgacattcgcattcgcgaggtcggcattggcgcaaaccagcagcgctgcacgatccgtgccgccaagctcgagaccggcaacccgcagcgccagatcgccaaggacgacgtgctgctcgtttctggcggcgctcgcggcatcacgcctctttgcatccgggagatcacgcgccagatcgcgggcggcaagtacattctgcttggccgcagcaaggtctctgcgagcgaaccggcatggtgcgctggcatcactgacgagaaggctgtgcaaaaggctgctacccaggagctcaagcgcgcctttagcgctggcgagggccccaagcccacgccccgcgctgtcactaagcttgtgggctctgttcttggcgctcgcgaggtgcgcagctctattgctgcgattgaagcgctcggcggcaaggccatctactcgtcgtgcgacgtgaactctgccgccgacgtggccaaggccgtgcgcgatgccgagtcccagctcggtgcccgcgtctcgggcatcgttcatgcctcgggcgtgctccgcgaccgtctcatcgagaagaagctccccgacgagttcgacgccgtctttggcaccaaggtcaccggtctcgagaacctcctcgccgccgtcgaccgcgccaacctcaagcacatggtcctcttcagctcgctcgccggcttccacggcaacgtcggccagtctgactacgccatggccaacgaggcccttaacaagatgggcctcgagctcgccaaggacgtctcggtcaagtcgatctgcttcggtccctgggacggtggcatggtgacgccgcagctcaagaagcagttccaggagatgggcgtgcagatcatcccccgcgagggcggcgctgataccgtggcgcgcatcgtgctcggctcctcgccggctgagatccttgtcggcaactggcgcaccccgtccaagaaggtcggctcggacaccatcaccctgcaccgcaagatttccgccaagtccaaccccttcctcgaggaccacgtcatccagggccgccgcgtgctgcccatgacgctggccattggctcgctcgcggagacctgcctcggcctcttccccggctactcgctctgggccattgacgacgcccagctcttcaagggtgtcactgtcgacggcgacgtcaactgcgaggtgaccctcaccccgtcgacggcgccctcgggccgcgtcaacgtccaggccacgctcaagaccttttccagcggcaagctggtcccggcctaccgcgccgtcatcgtgctctccaaccagggcgcgcccccggccaacgccaccatgcagccgccctcgctcgatgccgatccggcgctccagggctccgtctacgacggcaagaccctcttccacggcccggccttccgcggcatcgatgacgtgctctcgtgcaccaagagccagcttgtggccaagtgcagcgctgtccccggctccgacgccgctcgcggcgagtttgccacggacactgacgcccatgaccccttcgtgaacgacctggcctttcaggccatgctcgtctgggtgcgccgcacgctcggccaggctgcgctccccaactcgatccagcgcatcgtccagcaccgcccggtcccgcaggacaagcccttctacattaccctccgctccaaccagtcgggcggtcactcccagcacaagcacgcccttcagttccacaacgagcagggcgatctcttcattgatgtccaggcttcggtcatcgccacggacagccttgccttctaaatctaaactaggccatggtgacttaaggtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccggccatctaggccggatccacaaccaaaaatggccgctcgcaacgtgtctgcagcgcatgagatgcacgatgaaaagcgcatcgccgtcgtcggcatggccgtccagtacgccggatgcaaaaccaaggacgagttctgggaggtgctcatgaacggcaaggtcgagtccaaggtgatcagcgacaaacgactcggctccaactaccgcgccgagcactacaaagcagagcgcagcaagtatgccgacaccttttgcaacgaaacgtacggcacccttgacgagaacgagatcgacaacgagcacgaactcctcctcaacctcgccaagcaggcactcgcagagacatccgtcaaagactcgacacgctgcggcatcgtcagcggctgcctctcgttccccatggacaacctccagggtgaactcctcaacgtgtaccaaaaccatgtcgagaaaaagctcggggcccgcgtcttcaaggacgcctcccattggtccgaacgcgagcagtccaacaaacccgaggccggtgaccgccgcatcttcatggacccggcctccttcgtcgccgaagaactcaacctcggcgcccttcactactccgtcgacgcagcatgcgccacggcgctctacgtgctccgcctcgcgcaggatcatctcgtctccggcgccgccgacgtcatgctctgcggtgccacctgcctgccggagccctttttcatcctttcgggcttttccaccttccaggccatgcccgtcggcacgggccagaacgtgtccatgccgctgcacaaggacagccagggcctcaccccgggtgagggcggctccatcatggtcctcaagcgtctcgatgatgccatccgcgacggcgaccacatctacggcacccttctcggcgccaatgtcagcaactccggcacaggtctgcccctcaagccccttctccccagcgagaaaaagtgcctcatggacacctacacgcgcattaacgtgcacccgcacaagattcagtacgtcgagtgccacgccaccggcacgccccagggtgatcgtgtggaaatcgacgccgtcaaggcctgctttgaaggcaaggtcccccgtttcggtaccacaaagggcaactttggacacaccctcgtcgcagccggctttgccggtatgtgcaaggtcctcctctccatgaagcatggcatcatcccgcccaccccgggtatcgatgacgagaccaagatggaccctctcgtcgtctccggtgaggccatcccatggccagagaccaacggcgagcccaagcgcgccggtctctcggcctttggctttggtggcaccaacgcccatgccgtctttgaggagcatgacccctccaacgccgcctgcacgggccacgactccatttctgcgctctcggcccgctgcggcggtgaaagcaacatgcgcatcgccatcactggtatggacgccacctttggcgctctcaagggactcgacgccttcgagcgcgccatttacaccggcgctcacggtgccatcccactcccagaaaagcgctggcgctttctcggcaaggacaaggactttcttgacctctgcggcgtcaaggccaccccgcacggctgctacattgaagatgttgaggtcgacttccagcgcctccgcacgcccatgacccctgaagacatgctcctccctcagcagcttctggccgtcaccaccattgaccgcgccatcctcgactcgggaatgaaaaagggtggcaatgtcgccgtctttgtcggcctcggcaccgacctcgagctctaccgtcaccgtgctcgcgtcgctctcaaggagcgcgtccgccctgaagcctccaagaagctcaatgacatgatgcagtacattaacgactgcggcacatccacatcgtacacctcgtacattggcaacctcgtcgccacgcgcgtctcgtcgcagtggggcttcacgggcccctcctttacgatcaccgagggcaacaactccgtctaccgctgcgccgagctcggcaagtacctcctcgagaccggcgaggtcgatggcgtcgtcgttgcgggtgtcgatctctgcggcagtgccgaaaacctttacgtcaagtctcgccgcttcaaggtgtccacctccgataccccgcgcgccagctttgacgccgccgccgatggctactttgtcggcgagggctgcggtgcctttgtgctcaagcgtgagactagctgcaccaaggacgaccgtatctacgcttgcatggatgccatcgtccctggcaacgtccctagcgcctgcttgcgcgaggccctcgaccaggcgcgcgtcaagccgggcgatatcgagatgctcgagctcagcgccgactccgcccgccacctcaaggacccgtccgtcctgcccaaggagctcactgccgaggaggaaatcggcggccttcagacgatccttcgtgacgatgacaagctcccgcgcaacgtcgcaacgggcagtgtcaaggccaccgtcggtgacaccggttatgcctctggtgctgccagcctcatcaaggctgcgctttgcatctacaaccgctacctgcccagcaacggcgacgactgggatgaacccgcccctgaggcgccctgggacagcaccctctttgcgtgccagacctcgcgcgcttggctcaagaaccctggcgagcgtcgctatgcggccgtctcgggcgtctccgagacgcgctcgtgctattccgtgctcctctccgaagccgagggccactacgagcgcgagaaccgcatctcgctcgacgaggaggcgcccaagctcattgtgcttcgcgccgactcccacgaggagatccttggtcgcctcgacaagatccgcgagcgcttcttgcagcccacgggcgccgccccgcgcgagtccgagctcaaggcgcaggcccgccgcatcttcctcgagctcctcggcgagacccttgcccaggatgccgcttcttcaggctcgcaaaagcccctcgctctcagcctcgtctccacgccctccaagctccagcgcgaggtcgagctcgcggccaagggtatcccgcgctgcctcaagatgcgccgcgattggagctcccctgctggcagccgctacgcgcctgagccgctcgccagcgaccgcgtcgccttcatgtacggcgaaggtcgcagcccttactacggcatcacccaagacattcaccgcatttggcccgaactccacgaggtcatcaacgaaaagacgaaccgtctctgggccgaaggcgaccgctgggtcatgccgcgcgccagcttcaagtcggagctcgagagccagcagcaagagtttgatcgcaacatgattgaaatgttccgtcttggaatcctcacctcaattgccttcaccaatctggcgcgcgacgttctcaacatcacgcccaaggccgcctttggcctcagtcttggcgagatttccatgatttttgccttttccaagaagaacggtctcatctccgaccagctcaccaaggatcttcgcgagtccgacgtgtggaacaaggctctggccgttgaatttaatgcgctgcgcgaggcctggggcattccacagagtgtccccaaggacgagttctggcaaggctacattgtgcgcggcaccaagcaggatatcgaggcggccatcgccccggacagcaagtacgtgcgcctcaccatcatcaatgatgccaacaccgccctcattagcggcaagcccgacgcctgcaaggctgcgatcgcgcgtctcggtggcaacattcctgcgcttcccgtgacccagggcatgtgcggccactgccccgaggtgggaccttataccaaggatatcgccaagatccatgccaaccttgagttccccgttgtcgacggccttgacctctggaccacaatcaaccagaagcgcctcgtgccacgcgccacgggcgccaaggacgaatgggccccttcttcctttggcgagtacgccggccagctctacgagaagcaggctaacttcccccaaatcgtcgagaccatttacaagcaaaactacgacgtctttgtcgaggttgggcccaacaaccaccgtagcaccgcagtgcgcaccacgcttggtccccagcgcaaccaccttgctggcgccatcgacaagcagaacgaggatgcttggacgaccatcgtcaagcttgtggcttcgctcaaggcccaccttgttcctggcgtcacgatctcgccgctgtaccactccaagcttgtggcggaggctgaggcttgctacgctgcgctctgcaagggtgaaaagcccaagaagaacaagtttgtgcgcaagattcagctcaacggtcgcttcaacagcaaggcggaccccatctcctcggccgatcttgccagctttccgcctgcggaccctgccattgaagccgccatctcgagccgcatcatgaagccggttgctccgaagttctacgcgcgtctcaacattgacgagcaggacgagacccgtgatccgatcctcaacaaggacaacgcgccgtcttccagctctagctcctcttccagctcttccagctcttccagcccgtcgccagctccgtccgccccagtgcaaaagaaggctgctccggccgcggagaccaaggctgttgcttcggctgacgcacttcgcagtgccctgctcgatctcgacagtatgcttgcgctgagctctgccagtgcctccggcaaccttgttgagactgcgcctagcgacgcctcggtcattgtgccgccctgcaacattgcggatctcggcagccgcgccttcatgaaaacgtacggtgtttcggcgcctctgtacacgggcgccatggccaagggcattgcctctgcggacctcgtcattgccgccggccgccagggcatccttgcgtcctttggcgccggcggacttcccatgcaggttgtgcgtgagtccatcgaaaagattcaggccgccctgcccaatggcccgtacgctgtcaaccttatccattctccctttgacagcaacctcgaaaagggcaatgtcgatctcttcctcgagaagggtgtcacctttgtcgaggcctcggcctttatgacgctcaccccgcaggtcgtgcggtaccgcgcggctggcctcacgcgcaacgccgacggctcggtcaacatccgcaaccgtatcattggcaaggtctcgcgcaccgagctcgccgagatgttcatgcgtcctgcgcccgagcaccttcttcagaagctcattgcttccggcgagatcaaccaggagcaggccgagctcgcccgccgtgttcccgtcgctgacgacatcgcggtcgaagctgactcgggtggccacaccgacaaccgccccatccacgtcattctgcccctcatcatcaaccttcgcgaccgccttcaccgcgagtgcggctacccggccaaccttcgcgtccgtgtgggcgccggcggtggcattgggtgcccccaggcggcgctggccaccttcaacatgggtgcctcctttattgtcaccggcaccgtgaaccaggtcgccaagcagtcgggcacgtgcgacaatgtgcgcaagcagctcgcgaaggccacttactcggacgtatgcatggccccggctgccgacatgttcgaggaaggcgtcaagcttcaggtcctcaagaagggaaccatgtttccctcgcgcgccaacaagctctacgagctcttttgcaagtacgactcgttcgagtccatgccccccgcagagcttgcgcgcgtcgagaagcgcatcttcagccgcgcgctcgaagaggtctgggacgagaccaaaaacttttacattaaccgtcttcacaacccggagaagatccagcgcgccgagcgcgaccccaagctcaagatgtcgctgtgctttcgctggtacctgagcctggcgagccgctgggccaacactggagcttccgatcgcgtcatggactaccaggtctggtgcggtcctgccattggttccttcaacgatttcatcaagggaacttaccttgatccggccgtcgcaaacgagtacccgtgcgtcgttcagattaacaagcagatccttcgtggagcgtgcttcttgcgccgtctcgaaattctgcgcaacgcacgcctttccgatggcgctgccgctcttgtggccagcatcgatgacacatacgtcccggccgagaagctgtgagtagttagcttaatcacttaggtcaccggcctagtaggccggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccggccatctaggccggatccacaaccaaaaatggcgctccgtgtcaagacgaacaagaagccatgctgggagatgaccaaggaggagctgaccagcggcaagaccgaggtgttcaactatgaggaactcctcgagttcgcagagggcgacatcgccaaggtcttcggacccgagttcgccgtcatcgacaagtacccgcgccgcgtgcgcctgcccgcccgcgagtacctgctcgtgacccgcgtcaccctcatggacgccgaggtcaacaactaccgcgtcggcgcccgcatggtcaccgagtacgatctccccgtcaacggagagctctccgagggcggagactgcccctgggccgtcctggtcgagagtggccagtgcgatctcatgctcatctcctacatgggcattgacttccagaaccagggcgaccgcgtctaccgcctgctcaacaccacgctcaccttttacggcgtggcccacgagggcgagaccctcgagtacgacattcgcgtcaccggcttcgccaagcgtctcgacggcggcatctccatgttcttcttcgagtacgactgctacgtcaacggccgcctcctcatcgagatgcgcgatggctgcgccggcttcttcaccaacgaggagctcgacgccggcaagggcgtcgtcttcacccgcggcgacctcgccgcccgcgccaagatcccaaagcaggacgtctccccctacgccgtcgccccctgcctccacaagaccaagctcaacgaaaaggagatgcagaccctcgtcgacaaggactgggcatccgtctttggctccaagaacggcatgccggaaatcaactacaaactctgcgcgcgtaagatgctcatgattgaccgcgtcaccagcattgaccacaagggcggtgtctacggcctcggtcagctcgtcggtgaaaagatcctcgagcgcgaccactggtactttccctgccactttgtcaaggatcaggtcatggccggatccctcgtctccgacggctgcagccagatgctcaagatgtacatgatctggctcggcctccacctcaccaccggaccctttgacttccgcccggtcaacggccaccccaacaaggtccgctgccgcggccaaatctccccgcacaagggcaagctcgtctacgtcatggagatcaaggagatgggcttcgacgaggacaacgacccgtacgccattgccgacgtcaacatcattgatgtcgacttcgaaaagggccaggactttagcctcgaccgcatcagcgactacggcaagggcgacctcaacaagaagatcgtcgtcgactttaagggcatcgctctcaagatgcagaagcgctccaccaacaagaacccctccaaggttcagcccgtctttgccaacggcgccgccactgtcggccccgaggcctccaaggcttcctccggcgccagcgccagcgccagcgccgccccggccaagcctgccttcagcgccgatgttcttgcgcccaagcccgttgcccttcccgagcacatcctcaagggcgacgccctcgcccccaaggagatgtcctggcaccccatggcccgcatcccgggcaacccgacgccctcttttgcgccctcggcctacaagccgcgcaacatcgcctttacgcccttccccggcaaccccaacgataacgaccacaccccgggcaagatgccgctcacctggttcaacatggccgagttcatggccggcaaggtcagcatgtgcctcggccccgagttcgccaagttcgacgactcgaacaccagccgcagccccgcttgggacctcgctctcgtcacccgcgccgtgtctgtgtctgacctcaagcacgtcaactaccgcaacatcgacctcgacccctccaagggtaccatggtcggcgagttcgactgccccgcggacgcctggttctacaagggcgcctgcaacgatgcccacatgccgtactcgatcctcatggagatcgccctccagacctcgggtgtgctcacctcggtgctcaaggcgcccctgaccatggagaaggacgacatcctcttccgcaacctcgacgccaacgccgagttcgtgcgcgccgacctcgactaccgcggcaagactatccgcaacgtcaccaagtgcactggctacagcatgctcggcgagatgggcgtccaccgcttcacctttgagctctacgtcgatgatgtgctcttttacaagggctcgacctcgttcggctggttcgtgcccgaggtctttgccgcccaggccggcctcgacaacggccgcaagtcggagccctggttcattgagaacaaggttccggcctcgcaggtctcctcctttgacgtgcgccccaacggcagcggccgcaccgccatcttcgccaacgcccccagcggcgcccagctcaaccgccgcacggaccagggccagtacctcgacgccgtcgacattgtctccggcagcggcaagaagagcctcggctacgcccacggttccaagacggtcaacccgaacgactggttcttctcgtgccacttttggtttgactcggtcatgcccggaagtctcggtgtcgagtccatgttccagctcgtcgaggccatcgccgcccacgaggatctcgctggcaagcacggcattgccaaccccacctttgtgcacgccccgggcaagatcagctggaagtaccgcggccagctcacgcccaagagcaagaagatggactcggaggtccacatcgtgtccgtggacgcccacgacggcgttgtcgacctcgtcgccgacggcttcctctgggccgacagcctccgcgtctactcggtgagcaacattcgcgtgcgcatcgcctccggtgaggcccctgccgccgcctcctccgccgcctctgtgggctcctcggcttcgtccgtcgagcgcacgcgctcgagccccgctgtcgcctccggcccggcccagaccatcgacctcaagcagctcaagaccgagctcctcgagctcgatgccccgctctacctctcgcaggacccgaccagcggccagctcaagaagcacaccgacgtggcctccggccaggccaccatcgtgcagccctgcacgctcggcgacctcggtgaccgctccttcatggagacctacggcgtcgtcgccccgctgtacacgggcgccatggccaagggcattgcctcggcggacctcgtcatcgccgccggcaagcgcaagatcctcggctcctttggcgccggcggcctccccatgcaccacgtgcgcgccgccctcgagaagatccaggccgccctgcctcagggcccctacgccgtcaacctcatccactcgccttttgacagcaacctcgagaagggcaacgtcgatctcttcctcgagaagggcgtcactgtggtggaggcctcggcattcatgaccctcaccccgcaggtcgtgcgctaccgcgccgccggcctctcgcgcaacgccgacggttcggtcaacatccgcaaccgcatcatcggcaaggtctcgcgcaccgagctcgccgagatgttcatccgcccggccccggagcacctcctcgagaagctcatcgcctcgggcgagatcacccaggagcaggccgagctcgcgcgccgcgttcccgtcgccgacgatatcgctgtcgaggctgactcgggcggccacaccgacaaccgccccatccacgtcatcctcccgctcatcatcaacctccgcaaccgcctgcaccgcgagtgcggctaccccgcgcacctccgcgtccgcgttggcgccggcggtggcgtcggctgcccgcaggccgccgccgccgcgctcaccatgggcgccgccttcatcgtcaccggcactgtcaaccaggtcgccaagcagtccggcacctgcgacaacgtgcgcaagcagctctcgcaggccacctactcggatatctgcatggccccggccgccgacatgttcgaggagggcgtcaagctccaggtcctcaagaagggaaccatgttcccctcgcgcgccaacaagctctacgagctcttttgcaagtacgactccttcgactccatgcctcctgccgagctcgagcgcatcgagaagcgtatcttcaagcgcgcactccaggaggtctgggaggagaccaaggacttttacattaacggtctcaagaacccggagaagatccagcgcgccgagcacgaccccaagctcaagatgtcgctctgcttccgctggtaccttggtcttgccagccgctgggccaacatgggcgccccggaccgcgtcatggactaccaggtctggtgtggcccggccattggcgccttcaacgacttcatcaagggcacctacctcgaccccgctgtctccaacgagtacccctgtgtcgtccagatcaacctgcaaatcctccgtggtgcctgctacctgcgccgtctcaacgccctgcgcaacgacccgcgcattgacctcgagaccgaggatgctgcctttgtctacgagcccaccaacgcgctctaatgagtagttagcttaatcacttaggtcaccggcctagtaggccggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaatcacgagtggatgactgtcacgactgactcatgactgactactagtgctagcctcgaggtcgacacaactttgtataataaagttgtctagacctaggcgagtcatgagtcgtgacatgacgtcatgctcatcagactgcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccggccatctaggccggatccacaaccaaaaatggctcccactcccgacgccaccgcgcctctgaacaagccgagcgactatgccgtctaccacgaggaagacggccccttctggaccgccgattccagcggcgtctcgcgcgtgaactttagcgagaccggcgtgggatccgagggcgtcatccctgcgctcacgctcatcgacgtcttcgagagggccgtcaagcgcggcggaaacaggatcgccttccgcacggaaaacatgcccacgctccgccgcggcgaagaggccccggacgcgctgccgctcaaggactggaagtcctggtcctggaaacagtacaaggccgacgtccaccgcatcgccagggctctcatggacctcggcgttgagcagcatgacgccgtctccatttttggctttaactcgcccgaatggtttctcagtgccgtcggcgccgtgcacgcaggtgccaagattgccggcatttacccctcagacacgcccgcccaggtccagtacaaggccttccacagtgacaccgctgttgccgttgtcgaaaacgagcagtgcttcaagaagttcgccgaggtcgtcgaggaccttccttacctcaaggccattgtttgctgggactatgaagccacagacatcacgcgcgaggacggctccgtcgtcgaggtcctcacctttgccgagttcctcaagcgcggcgacaccgtcgaggcggccgcccttgacgagcgcatctccaagatcgagcccaccatgtgcgctgcccttatttacaccagcggtactaccggccgccccaaggccgttatgatttcgcacgacaaccttgttttcgaggccagcgccgtcgtccccaacctcggaggagcctgtacgaccactgctgaggagcgcattctctcgtacctgcctctctcgcacgtcgctggtatgatggttgatattattgcccccatcattgccaccgccttccacaagggccgcatctgcgtctgctttgctcgcccgtacgatttgcgcaccggcacgctgggccagcgcctcaacgccgtggagcccaccatcttccttggcgtgccccgtgtgtgggaaaagattcaggaaaagctcatggccgtcggtgccaaaaccaccggcctcaagaagaagctctctacggccgccaagaagcgtggtcttgaattccaggaggagcagcaaatcggccgctccggtgccaaccctggctttggcccccttggcatctacaagaagctcctcggcctcatcaagggcaagctgggcctcaccaagtgcaagtttgcctttgctggtgccgcgcccatgacccgtgagacccttcagtactttggcgcgctgaacatcaacattaacgaggtctacggcatgtccgagtgctccggtgccgccacctggtccacggacaaggcccacgagtggggcactgttggctacgagatgcccagttgcgaggtccgcgtcttcaagattgccgaggacggtaccaagaccgagtgcccgcgcgccgccgacattatgcatgctaccgaggaggagcagggcgaagtttgcttccgcggccgtaacatcatgatgggctaccttgccaaccccaagcttggcgacgaccacgttgccgagatcgaggagaagaacgctgccgctatcgactccgagggctggctccacagtggtgataagggcgccatttctacccgcggcatgctcaagatcacgggccgctacaaggagctcatcatcggcgccggtggcgagaacgtggcgcccgtccctattgaggacgccatcaaggcgcgcatgccttttgtttccaacgccatgatggtcggagataagcgcaagttcatggctgtcctccttaccctcaagacggttggcgccacgggcgagcttcccggtacgaacaagctcatgggcgctgccgccgactatggtgagaccatcgaggacgcctgcgacaacgaggcgctcattgaggagatcacgcagcagctcaaggagatcggtgatgatggcgatgtcacgccctcgaacgcggctcgcatccaaaagttcaccattctcccgctcgacttttccgtctccacggacgagctcacggccacgctcaagctcaagcgctccgtggtcgcagacaagtacgaagacatcatcgaggccttttacgagtccaagagcgtttttgtgccgtactcgaccgttggcgcctacgccacgggcggcccggtcgacgactccgttgtcgatggctccttcaagggcgactttagcatgattggcgacgatgatccggatcttcaaaacgtcgatgtcctcgaggcgattgacgaggacaattaaatttgagtagttagcttaatcacttaggtcaccggcctagtaggccggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaatctgatcatggatgctacgtcacggcagtacaggactatcactagacctaggagctgtgctgggtaactcacatgagtcactggtcacatcagcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgttgcagcatacttggctaccaaaacccccaaatttaaccttattgtcagatgaagttcatctctggcgcattccccttgaccaaccagaatcacagctacaggatttagccgctaccttatctagtgacgaattagcccgtgcaaacagattttattttcccgaacatcgccggcgttttactgctggtcgtggtattctccgcagtatcttggggggctatttgggtgtggaaccagggcaagttaaatttgattatgaatcccgtggtaaaccaatattaggcgatcgctttgccgagagtggtttattatttaacttgtcacactcccagaacttggccttgtgtgcagtcaattacacgcgccaaatcggcatcgatttagaatatctccgccccacatctgatttagaatcccttgccaaaaggttctttttaccgcgagaatatgaattattgcgatcgctacccgatgagcaaaaacaaaaaattttctttcgttactggacttgtaaagaggcttatcttaaagcaacgggtgacggcatcgctaaattagaggaaattgaaatagcactaactcccacagaaccagctaagttacagacagctccagcgtggagtctcctagagctagtgccagatgataattgtgttgctgctgttgccgtggcgggttttggctggcagccaaaattctggcattattgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagttt

SEQ ID NO: 45 - DNA, 46978 bp, Artificial sequence
  plasmid pDAB9330
gtacaaaaaagcaggcttctagacctaggtggagtcatcacgcagactatctcagcatgtgcgtagcacgcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaatcacgagtggatgactgtcacgactgactcatgactgactactagtgctagcctcgaggtcgacacaactttgtataataaagttgtctagacctaggcgagtcatgagtcgtgacatgacgtcatgctcatcagactgcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcccactccagatgccactgcgcctctcaacaagccgtcagactatgctgtgtaccacgaagaggatggtcctttctggactgctgattcctctggtgtcagcagagtgaacttctctgaaactggtgtgggatctgaaggtgtcattcctgcgctcacactgattgatgtgtttgagcgtgcggtcaaacgtggtggcaataggattgcattcagaacagagaacatgccaaccttgaggcgtggagaagaggctcctgatgctttgccgctcaaagattggaagtcctggtcttggaaacagtacaaagctgatgttcacagaattgcgagggctctgatggatttgggagttgagcagcacgatgcggtctccatctttggcttcaactcaccagaatggttcctcagtgctgtcggtgcagttcatgctggtgccaagatcgctggaatctacccttcagacactcctgctcaagtgcagtacaaagccttccactctgacactgctgttgcagttgtggagaacgaacagtgcttcaagaaattcgcagaggtggttgaggatctcccttacctcaaagccattgtttgttgggattatgaagccacagacatcacaagggaagatggttcagtggttgaagtcctgacctttgctgagttcctgaagagaggtgacactgtggaagcagctgcacttgatgagagaatcagcaagattgagcccaccatgtgtgctgccctgatctacaccagtggcacaactgggagacccaaagctgtcatgatctcccatgacaaccttgtctttgaagcatctgctgtggtcccgaacttgggaggggcatgcacgaccactgctgaggaaaggattctttcctaccttcctttgtctcatgttgctggaatgatggttgacatcattgctccaatcatagcgacagcgttccacaaaggaaggatctgtgtttgttttgccagaccgtatgatttgagaactggaacccttgggcaaagactcaatgcagtggagccaaccatattccttggtgtgccacgtgtgtgggaaaagatccaagagaaattgatggctgttggtgccaaaaccactggtctcaagaagaaactcagcacggcagccaagaaacgtgggcttgaatttcaagaggaacaacagatagggagaagtggtgccaaccctggctttggaccgcttggaatctacaagaaacttttgggcctcatcaaaggaaagttggggctgaccaaatgcaagtttgcctttgctggcgcagctccaatgacccgtgaaacccttcagtactttggagcgctgaacatcaacatcaatgaggtctatggaatgtctgaatgcagtggggctgccacctggtcaactgacaaagctcatgagtggggcactgttggctatgagatgccctcctgtgaagtcagagtgttcaagattgcggaggatggcaccaagacagagtgcccaagagctgctgacatcatgcatgccacagaagaggaacaaggtgaagtttgcttccgtggaaggaacatcatgatgggatacttggccaacccgaaacttggtgatgaccatgttgctgagattgaagagaagaatgcagctgccatagatagcgaagggtggcttcactctggtgacaagggagcaatttccacaaggggaatgctcaagataacgggcagatacaaggagcttatcataggtgctggtggggagaatgtggctcctgttcccattgaagatgccatcaaggcgaggatgccttttgtttcaaatgcaatgatggttggagacaagaggaagttcatggctgtccttctgactttgaaaacggttggagcaactggagagcttcctggcacaaacaagctcatgggagcagctgcggactatggtgagaccattgaggatgcctgtgacaatgaggcgctcattgaagagataacgcagcaactcaaagagataggtgacgatggagatgtcacgccaagcaatgcagcccgtatacaaaagttcacgattttgccactcgacttcagtgtctccacagatgaactgacagcaacgttgaaattgaagagaagtgtggttgcagacaagtatgaggacatcatagaggctttctatgagagcaagtctgtctttgtgccttactcaacagttggagcttatgcaacgggtggaccagttgatgactctgttgtggatggatcattcaaaggtgactttagcatgattggggatgacgatccggatcttcagaatgtggatgtccttgaagcaattgatgaggacaactgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaatctgatcatggatgctacgtcacggcagtacaggactatcactagacctaggagctgtgctgggtaactcacatgagtcactggtcacatcagcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagttt

SEQ ID NO: 46 - DNA, 41726 bp, Artificial sequence
  plasmid pDAB9337
gtacaaaaaagcaggcttctagacctaggtggagtcatcacgcagactatctcagcatgtgcgtagcacgcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagttt

SEQ ID NO: 47 - DNA, 36797 bp, Artificial sequence
  plasmid pDAB9338
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagcttt

SEQ ID NO: 48 - DNA, 42674 bp, Artificial sequence
  plasmid pDAB9344
gtacaaaaaagcaggcttctagacctaggtggagtcatcacgcagactatctcagcatgtgcgtagcacgcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaagcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaagctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaagcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcttcctctatgctctcttccgctactatggttgcctctccggctcaggccactatggtcgctcctttcaacggacttaagtcctccgctgccttcccagccacccgcaaggctaacaacgacattacttccatcacaagcaacggcggaagagttaactgcatgcaggtgtggcctccgattggaaagaagaagtttgagactctctcttaccttcctgaccttaccgattccgaacttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagttt

SEQ ID NO: 49 - DNA, 40406 bp, Artificial sequence
  plasmid pDAB9396
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggcgagtcatgagtcgtgacatgacgtcatgctcatcagactgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcccactccagatgccactgcgcctctcaacaagccgtcagactatgctgtgtaccacgaagaggatggtcctttctggactgctgattcctctggtgtcagcagagtgaacttctctgaaactggtgtgggatctgaaggtgtcattcctgcgctcacactgattgatgtgtttgagcgtgcggtcaaacgtggtggcaataggattgcattcagaacagagaacatgccaaccttgaggcgtggagaagaggctcctgatgctttgccgctcaaagattggaagtcctggtcttggaaacagtacaaagctgatgttcacagaattgcgagggctctgatggatttgggagttgagcagcacgatgcggtctccatctttggcttcaactcaccagaatggttcctcagtgctgtcggtgcagttcatgctggtgccaagatcgctggaatctacccttcagacactcctgctcaagtgcagtacaaagccttccactctgacactgctgttgcagttgtggagaacgaacagtgcttcaagaaattcgcagaggtggttgaggatctcccttacctcaaagccattgtttgttgggattatgaagccacagacatcacaagggaagatggttcagtggttgaagtcctgacctttgctgagttcctgaagagaggtgacactgtggaagcagctgcacttgatgagagaatcagcaagattgagcccaccatgtgtgctgccctgatctacaccagtggcacaactgggagacccaaagctgtcatgatctcccatgacaaccttgtctttgaagcatctgctgtggtcccgaacttgggaggggcatgcacgaccactgctgaggaaaggattctttcctaccttcctttgtctcatgttgctggaatgatggttgacatcattgctccaatcatagcgacagcgttccacaaaggaaggatctgtgtttgttttgccagaccgtatgatttgagaactggaacccttgggcaaagactcaatgcagtggagccaaccatattccttggtgtgccacgtgtgtgggaaaagatccaagagaaattgatggctgttggtgccaaaaccactggtctcaagaagaaactcagcacggcagccaagaaacgtgggcttgaatttcaagaggaacaacagatagggagaagtggtgccaaccctggctttggaccgcttggaatctacaagaaacttttgggcctcatcaaaggaaagttggggctgaccaaatgcaagtttgcctttgctggcgcagctccaatgacccgtgaaacccttcagtactttggagcgctgaacatcaacatcaatgaggtctatggaatgtctgaatgcagtggggctgccacctggtcaactgacaaagctcatgagtggggcactgttggctatgagatgccctcctgtgaagtcagagtgttcaagattgcggaggatggcaccaagacagagtgcccaagagctgctgacatcatgcatgccacagaagaggaacaaggtgaagtttgcttccgtggaaggaacatcatgatgggatacttggccaacccgaaacttggtgatgaccatgttgctgagattgaagagaagaatgcagctgccatagatagcgaagggtggcttcactctggtgacaagggagcaatttccacaaggggaatgctcaagataacgggcagatacaaggagcttatcataggtgctggtggggagaatgtggctcctgttcccattgaagatgccatcaaggcgaggatgccttttgtttcaaatgcaatgatggttggagacaagaggaagttcatggctgtccttctgactttgaaaacggttggagcaactggagagcttcctggcacaaacaagctcatgggagcagctgcggactatggtgagaccattgaggatgcctgtgacaatgaggcgctcattgaagagataacgcagcaactcaaagagataggtgacgatggagatgtcacgccaagcaatgcagcccgtatacaaaagttcacgattttgccactcgacttcagtgtctccacagatgaactgacagcaacgttgaaattgaagagaagtgtggttgcagacaagtatgaggacatcatagaggctttctatgagagcaagtctgtctttgtgccttactcaacagttggagcttatgcaacgggtggaccagttgatgactctgttgtggatggatcattcaaaggtgactttagcatgattggggatgacgatccggatcttcagaatgtggatgtccttgaagcaattgatgaggacaactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgatcatggatgctacgtcacggcagtacaggactatcactagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagcttt

SEQ ID NO: 50 - DNA, 39630 bp, Artificial sequence
  plasmid pDAB101412
cttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaagatgagtgatactcaggactcaggactcactctgctgatcactagtgctagcctcgaggtcgacacaactttgtatacaaaagttgtctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaatctgacctgaccactagacctgagtgagtacagatgtgctactagtgctagcctcgaggtcgaccaacttttctatacaaagttgtctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaatcacgagtggatgactgtcacgactgactcatgactgactactagtgctagcctcgaggtcgacacaactttgtataataaagttgtctagacctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcccactccagatgccactgcgcctctcaacaagccgtcagactatgctgtgtaccacgaagaggatggtcctttctggactgctgattcctctggtgtcagcagagtgaacttctctgaaactggtgtgggatctgaaggtgtcattcctgcgctcacactgattgatgtgtttgagcgtgcggtcaaacgtggtggcaataggattgcattcagaacagagaacatgccaaccttgaggcgtggagaagaggctcctgatgctttgccgctcaaagattggaagtcctggtcttggaaacagtacaaagctgatgttcacagaattgcgagggctctgatggatttgggagttgagcagcacgatgcggtctccatctttggcttcaactcaccagaatggttcctcagtgctgtcggtgcagttcatgctggtgccaagatcgctggaatctacccttcagacactcctgctcaagtgcagtacaaagccttccactctgacactgctgttgcagttgtggagaacgaacagtgcttcaagaaattcgcagaggtggttgaggatctcccttacctcaaagccattgtttgttgggattatgaagccacagacatcacaagggaagatggttcagtggttgaagtcctgacctttgctgagttcctgaagagaggtgacactgtggaagcagctgcacttgatgagagaatcagcaagattgagcccaccatgtgtgctgccctgatctacaccagtggcacaactgggagacccaaagctgtcatgatctcccatgacaaccttgtctttgaagcatctgctgtggtcccgaacttgggaggggcatgcacgaccactgctgaggaaaggattctttcctaccttcctttgtctcatgttgctggaatgatggttgacatcattgctccaatcatagcgacagcgttccacaaaggaaggatctgtgtttgttttgccagaccgtatgatttgagaactggaacccttgggcaaagactcaatgcagtggagccaaccatattccttggtgtgccacgtgtgtgggaaaagatccaagagaaattgatggctgttggtgccaaaaccactggtctcaagaagaaactcagcacggcagccaagaaacgtgggcttgaatttcaagaggaacaacagatagggagaagtggtgccaaccctggctttggaccgcttggaatctacaagaaacttttgggcctcatcaaaggaaagttggggctgaccaaatgcaagtttgcctttgctggcgcagctccaatgacccgtgaaacccttcagtactttggagcgctgaacatcaacatcaatgaggtctatggaatgtctgaatgcagtggggctgccacctggtcaactgacaaagctcatgagtggggcactgttggctatgagatgccctcctgtgaagtcagagtgttcaagattgcggaggatggcaccaagacagagtgcccaagagctgctgacatcatgcatgccacagaagaggaacaaggtgaagtttgcttccgtggaaggaacatcatgatgggatacttggccaacccgaaacttggtgatgaccatgttgctgagattgaagagaagaatgcagctgccatagatagcgaagggtggcttcactctggtgacaagggagcaatttccacaaggggaatgctcaagataacgggcagatacaaggagcttatcataggtgctggtggggagaatgtggctcctgttcccattgaagatgccatcaaggcgaggatgccttttgtttcaaatgcaatgatggttggagacaagaggaagttcatggctgtccttctgactttgaaaacggttggagcaactggagagcttcctggcacaaacaagctcatgggagcagctgcggactatggtgagaccattgaggatgcctgtgacaatgaggcgctcattgaagagataacgcagcaactcaaagagataggtgacgatggagatgtcacgccaagcaatgcagcccgtatacaaaagttcacgattttgccactcgacttcagtgtctccacagatgaactgacagcaacgttgaaattgaagagaagtgtggttgcagacaagtatgaggacatcatagaggctttctatgagagcaagtctgtctttgtgccttactcaacagttggagcttatgcaacgggtggaccagttgatgactctgttgtggatggatcattcaaaggtgactttagcatgattggggatgacgatccggatcttcagaatgtggatgtccttgaagcaattgatgaggacaactgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaatctgatcatggatgctacgtcacggcagtacaggactatcactagacctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaactactgtcactgaggccgtagacgagtacggactgatctaactagtgctagcctcgaggtcgacacccagcttt

SEQ ID NO: 51 - DNA, 36936 bp, Artificial sequence
  plasmid pDAB7733
gatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaagatgagtgatactcaggactcaggactcactctgctgatcactagtgctagcctcgaggtcgacacaactttgtatacaaaagttgtctagacctaggttaattaagcggccgcagcttatttctcttttcgatactctaattgagccgtgcgctctatctagaccaattagaattgatggagctctaaaggttgctggctgttttcttgttcatatgattaacttctaaacttgtgtataaatattctctgaaagtgcttcttttggcatatgtaggttgggcaaaaacgaggaagattgcttctcaatttggaagatgatgaacagccgaagaagaaaataagaataggcagtcctgctactcaatggatctcagtctataacggtcgtcgtcccatgaaacagaggtaacacattttttgcatatacactttgatagttcctcactaactgtgtaatcttttggtagatatcactacaatgttggagagacaaggctgcgccagcatatacagaagggaaatgaagatggccttttgattagctgtgtagcatcagcagctaatctctgggctctcatcatggatgctggaactggattcacttctcaagtttatgagttgtcaccggtcttcctacacaaggtaataatcagttgaagcaattaagaatcaatctgatttgtagtaaactaagaagaacttaccttatgatttccccgcaggactggattatggaacaatgggaaaagaactactatataagctccatagcgggttcagataacgggagctctttagttgttatgtcaaaaggttagtgtttagtgaataataaacttattatcaaaaagtcttcattgacttatttatatacttgttgtgaattggtaggaactacttattctcagcagtcatacaaagtgagtgactcatttccattcaagtggataaataagaaatggaaagaagattttcatgtaacctccatgacaactgctggtaatcgttggggtgtggtaatgtcgaggaactctggcttctctgatcaggtaggtttttgtctcttattgtctggtgtttttattttcccctgatagtctaatatgataaactctgcgttgtgaaaggtggtggagcttgactttttgtacccaagcgatgggatacataggaggtgggagaatgggtatagaataacatcaatggcagcaactgcggatcaagcagctttcatattaagcataccaaagcgtaagatggtggatgaaactcaagagactctccgcaccaccgcctttccaagtactcatgtcaaggttggtttctttagctttgaacacagatttggatctttttgttttgtttccatatacataggacctgagagcttttggttgaattttttttttttcaggacaaatgggcgaagaatctgtacattgcatcaatatgctatggcaggacagtgtgctgatgatacacacttaagcatcatgtgttgtgttagaaagccgaagacaattggagcgagcctcagggtcgtcataataccaatcaaagacgtaaaaccagacgcagtctctttggttgaatgtgatgaaagggatgtgtcttggtatgtatgtacgagtaacaaaagagaagatgcaattgagtagtagaaagatttgagagctttttaaagcccttcaagtgtgtgcttttatcttattgatatcatccatttgcgttgtttaatgcgtctttagatatgtttctgtttctttctcagtgtctgaatatctgataagtgcaatgtgagaaagccacaccaaaccaaaatattcaaatcttatatttttaataatgtcgaatcactcggagttgccaccttctgtgccaattgtgctgaatctatcacactaaaaaaaacatttcttcaaggtaatgacttgtggactatgttctgaattctcattaagtttttattttttgaagtttaagtttttaccttcttttttgaaaaatatcgttcataagatgtcacgccaggacatgagctacacatcacatattagcatgcagatgcggacgatttgtcactcacttcaaacacctaaaagagcttctctctcacagcacacacacatatgcatgcaatatttacacgtgatcgccatgcaaatctccattctcacctataaattagaggctcggcttcactttttactcaaaccaaaactcatcactacaagatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcaccattccaaacgaaatatcctcgagagtgtgtataccacggtgatatgagtgtggttgttgatgtatgttaacactacatagtcatggtgtgtgttccataaataatgtactaatgtaataagaactactccgtagacggtaataaaagagaagtttttttttttactcttgctactttcctataaagtgatgattaacaacagatacaccaaaaagaaaacaattaatctatattcacaatgaagcagtactagtctattgaacatgtcagattttctttttctagatgtctaatcaagccttcaaggctagtgataaaagatcatccaatgggatccaacaaagactcaaatctggttttgatcagatacttcgaaactatttttgtatgcactaaattatgcaagtgttcttttatttggtgaagactctttagaagcaaagaacgataagcagtaataaaaaaaataaagttcagttttaagatttgttattgacttagcggccgcttaattaaactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagtctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctag

SEQ ID NO: 52 - DNA, 36767 bp, Artificial sequence
  plasmid pDAB7734
gatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaatctgacctgaccactagacctgagtgagtacagatgtgctactagtgctagcctcgaggtcgaccaacttttctatacaaagttgtctagacctaggttaattaagcggccgcagcttatttctcttttcgatactctaattgagccgtgcgctctatctagaccaattagaattgatggagctctaaaggttgctggctgttttcttgttcatatgattaacttctaaacttgtgtataaatattctctgaaagtgcttcttttggcatatgtaggttgggcaaaaacgaggaagattgcttctcaatttggaagatgatgaacagccgaagaagaaaataagaataggcagtcctgctactcaatggatctcagtctataacggtcgtcgtcccatgaaacagaggtaacacattttttgcatatacactttgatagttcctcactaactgtgtaatcttttggtagatatcactacaatgttggagagacaaggctgcgccagcatatacagaagggaaatgaagatggccttttgattagctgtgtagcatcagcagctaatctctgggctctcatcatggatgctggaactggattcacttctcaagtttatgagttgtcaccggtcttcctacacaaggtaataatcagttgaagcaattaagaatcaatctgatttgtagtaaactaagaagaacttaccttatgatttccccgcaggactggattatggaacaatgggaaaagaactactatataagctccatagcgggttcagataacgggagctctttagttgttatgtcaaaaggttagtgtttagtgaataataaacttattatcaaaaagtcttcattgacttatttatatacttgttgtgaattggtaggaactacttattctcagcagtcatacaaagtgagtgactcatttccattcaagtggataaataagaaatggaaagaagattttcatgtaacctccatgacaactgctggtaatcgttggggtgtggtaatgtcgaggaactctggcttctctgatcaggtaggtttttgtctcttattgtctggtgtttttattttcccctgatagtctaatatgataaactctgcgttgtgaaaggtggtggagcttgactttttgtacccaagcgatgggatacataggaggtgggagaatgggtatagaataacatcaatggcagcaactgcggatcaagcagctttcatattaagcataccaaagcgtaagatggtggatgaaactcaagagactctccgcaccaccgcctttccaagtactcatgtcaaggttggtttctttagctttgaacacagatttggatctttttgttttgtttccatatacataggacctgagagcttttggttgaattttttttttttcaggacaaatgggcgaagaatctgtacattgcatcaatatgctatggcaggacagtgtgctgatgatacacacttaagcatcatgtgttgtgttagaaagccgaagacaattggagcgagcctcagggtcgtcataataccaatcaaagacgtaaaaccagacgcagtctctttggttgaatgtgatgaaagggatgtgtcttggtatgtatgtacgagtaacaaaagagaagatgcaattgagtagtagaaagatttgagagctttttaaagcccttcaagtgtgtgcttttatcttattgatatcatccatttgcgttgtttaatgcgtctttagatatgtttctgtttctttctcagtgtctgaatatctgataagtgcaatgtgagaaagccacaccaaaccaaaatattcaaatcttatatttttaataatgtcgaatcactcggagttgccaccttctgtgccaattgtgctgaatctatcacactaaaaaaaacatttcttcaaggtaatgacttgtggactatgttctgaattctcattaagtttttattttttgaagtttaagtttttaccttcttttttgaaaaatatcgttcataagatgtcacgccaggacatgagctacacatcacatattagcatgcagatgcggacgatttgtcactcacttcaaacacctaaaagagcttctctctcacagcacacacacatatgcatgcaatatttacacgtgatcgccatgcaaatctccattctcacctataaattagaggctcggcttcactttttactcaaaccaaaactcatcactacaagatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcaccattccaaacgaaatatcctcgagagtgtgtataccacggtgatatgagtgtggttgttgatgtatgttaacactacatagtcatggtgtgtgttccataaataatgtactaatgtaataagaactactccgtagacggtaataaaagagaagtttttttttttactcttgctactttcctataaagtgatgattaacaacagatacaccaaaaagaaaacaattaatctatattcacaatgaagcagtactagtctattgaacatgtcagattttctttttctagatgtctaatcaagccttcaaggctagtgataaaagatcatccaatgggatccaacaaagactcaaatctggttttgatcagatacttcgaaactatttttgtatgcactaaattatgcaagtgttcttttatttggtgaagactctttagaagcaaagaacgataagcagtaataaaaaaaataaagttcagttttaagatttgttattgacttagcggccgcttaattaaactagtgctagcctcgaggtcgacacaactttgtataataaagttgtctagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacg

SEQ ID NO: 53 - DNA, 35494 bp, Artificial sequence
  plasmid pDAB101493
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagtctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 54 - DNA, 37935 bp, Artificial sequence
  plasmid pDAB109507
gtacaaaaaagcaggcttctagacctaggtggagtcatcacgcagactatctcagcatgtgcgtagcacgcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaagatgagtgatactcaggactcaggactcactctgctgatcactagtgctagcctcgaggtcgacacaactttgtatacaaaagttgtctagacctaggttaattaagcggccgcagcttatttctcttttcgatactctaattgagccgtgcgctctatctagaccaattagaattgatggagctctaaaggttgctggctgttttcttgttcatatgattaacttctaaacttgtgtataaatattctctgaaagtgcttcttttggcatatgtaggttgggcaaaaacgaggaagattgcttctcaatttggaagatgatgaacagccgaagaagaaaataagaataggcagtcctgctactcaatggatctcagtctataacggtcgtcgtcccatgaaacagaggtaacacattttttgcatatacactttgatagttcctcactaactgtgtaatcttttggtagatatcactacaatgttggagagacaaggctgcgccagcatatacagaagggaaatgaagatggccttttgattagctgtgtagcatcagcagctaatctctgggctctcatcatggatgctggaactggattcacttctcaagtttatgagttgtcaccggtcttcctacacaaggtaataatcagttgaagcaattaagaatcaatctgatttgtagtaaactaagaagaacttaccttatgatttccccgcaggactggattatggaacaatgggaaaagaactactatataagctccatagcgggttcagataacgggagctctttagttgttatgtcaaaaggttagtgtttagtgaataataaacttattatcaaaaagtcttcattgacttatttatatacttgttgtgaattggtaggaactacttattctcagcagtcatacaaagtgagtgactcatttccattcaagtggataaataagaaatggaaagaagattttcatgtaacctccatgacaactgctggtaatcgttggggtgtggtaatgtcgaggaactctggcttctctgatcaggtaggtttttgtctcttattgtctggtgtttttattttcccctgatagtctaatatgataaactctgcgttgtgaaaggtggtggagcttgactttttgtacccaagcgatgggatacataggaggtgggagaatgggtatagaataacatcaatggcagcaactgcggatcaagcagctttcatattaagcataccaaagcgtaagatggtggatgaaactcaagagactctccgcaccaccgcctttccaagtactcatgtcaaggttggtttctttagctttgaacacagatttggatctttttgttttgtttccatatacataggacctgagagcttttggttgaattttttttttttcaggacaaatgggcgaagaatctgtacattgcatcaatatgctatggcaggacagtgtgctgatgatacacacttaagcatcatgtgttgtgttagaaagccgaagacaattggagcgagcctcagggtcgtcataataccaatcaaagacgtaaaaccagacgcagtctctttggttgaatgtgatgaaagggatgtgtcttggtatgtatgtacgagtaacaaaagagaagatgcaattgagtagtagaaagatttgagagctttttaaagcccttcaagtgtgtgcttttatcttattgatatcatccatttgcgttgtttaatgcgtctttagatatgtttctgtttctttctcagtgtctgaatatctgataagtgcaatgtgagaaagccacaccaaaccaaaatattcaaatcttatatttttaataatgtcgaatcactcggagttgccaccttctgtgccaattgtgctgaatctatcacactaaaaaaaacatttcttcaaggtaatgacttgtggactatgttctgaattctcattaagtttttattttttgaagtttaagtttttaccttcttttttgaaaaatatcgttcataagatgtcacgccaggacatgagctacacatcacatattagcatgcagatgcggacgatttgtcactcacttcaaacacctaaaagagcttctctctcacagcacacacacatatgcatgcaatatttacacgtgatcgccatgcaaatctccattctcacctataaattagaggctcggcttcactttttactcaaaccaaaactcatcactacaagatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcaccattccaaacgaaatatcctcgagagtgtgtataccacggtgatatgagtgtggttgttgatgtatgttaacactacatagtcatggtgtgtgttccataaataatgtactaatgtaataagaactactccgtagacggtaataaaagagaagtttttttttttactcttgctactttcctataaagtgatgattaacaacagatacaccaaaaagaaaacaattaatctatattcacaatgaagcagtactagtctattgaacatgtcagattttctttttctagatgtctaatcaagccttcaaggctagtgataaaagatcatccaatgggatccaacaaagactcaaatctggttttgatcagatacttcgaaactatttttgtatgcactaaattatgcaagtgttcttttatttggtgaagactctttagaagcaaagaacgataagcagtaataaaaaaaataaagttcagttttaagatttgttattgacttagcggccgcttaattaaactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcagatctgattggtaagatatgggtactgtttggtttatatgttttgactattcagtcactatggcccccataaattttaattcggctggtatgtctcggttaagaccggtttgacatggttcatttcagttcaattatgttaatctggcacgtgatatgtttaccttcacacgaacattagtaatgatgggctaatttaagacttaacaggcctagagaggcccatcttattacgtaacggcgtcgtttagagtgcaccaagcttataaatgaaaacgagctacctcgggacatcacgctctttgtacactccgccatctctctctctcgttggagcagatctctctcgtgaatatcgacaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcaccctatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagttt

SEQ ID NO: 55 - DNA, 38239 bp, Artificial sequence
  plasmid pDAB109508
gtacaaaaaagcaggcttctagacctaggtggagtcatcacgcagactatctcagcatgtgcgtagcacgcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcgcggccgcttaattaagatgagtgatactcaggactcaggactcactctgctgatcactagtgctagcctcgaggtcgacacaactttgtatacaaaagttgtctagacctaggttaattaagcggccgcagcttatttctcttttcgatactctaattgagccgtgcgctctatctagaccaattagaattgatggagctctaaaggttgctggctgttttcttgttcatatgattaacttctaaacttgtgtataaatattctctgaaagtgcttcttttggcatatgtaggttgggcaaaaacgaggaagattgcttctcaatttggaagatgatgaacagccgaagaagaaaataagaataggcagtcctgctactcaatggatctcagtctataacggtcgtcgtcccatgaaacagaggtaacacattttttgcatatacactttgatagttcctcactaactgtgtaatcttttggtagatatcactacaatgttggagagacaaggctgcgccagcatatacagaagggaaatgaagatggccttttgattagctgtgtagcatcagcagctaatctctgggctctcatcatggatgctggaactggattcacttctcaagtttatgagttgtcaccggtcttcctacacaaggtaataatcagttgaagcaattaagaatcaatctgatttgtagtaaactaagaagaacttaccttatgatttccccgcaggactggattatggaacaatgggaaaagaactactatataagctccatagcgggttcagataacgggagctctttagttgttatgtcaaaaggttagtgtttagtgaataataaacttattatcaaaaagtcttcattgacttatttatatacttgttgtgaattggtaggaactacttattctcagcagtcatacaaagtgagtgactcatttccattcaagtggataaataagaaatggaaagaagattttcatgtaacctccatgacaactgctggtaatcgttggggtgtggtaatgtcgaggaactctggcttctctgatcaggtaggtttttgtctcttattgtctggtgtttttattttcccctgatagtctaatatgataaactctgcgttgtgaaaggtggtggagcttgactttttgtacccaagcgatgggatacataggaggtgggagaatgggtatagaataacatcaatggcagcaactgcggatcaagcagctttcatattaagcataccaaagcgtaagatggtggatgaaactcaagagactctccgcaccaccgcctttccaagtactcatgtcaaggttggtttctttagctttgaacacagatttggatctttttgttttgtttccatatacataggacctgagagcttttggttgaattttttttttttcaggacaaatgggcgaagaatctgtacattgcatcaatatgctatggcaggacagtgtgctgatgatacacacttaagcatcatgtgttgtgttagaaagccgaagacaattggagcgagcctcagggtcgtcataataccaatcaaagacgtaaaaccagacgcagtctctttggttgaatgtgatgaaagggatgtgtcttggtatgtatgtacgagtaacaaaagagaagatgcaattgagtagtagaaagatttgagagctttttaaagcccttcaagtgtgtgcttttatcttattgatatcatccatttgcgttgtttaatgcgtctttagatatgtttctgtttctttctcagtgtctgaatatctgataagtgcaatgtgagaaagccacaccaaaccaaaatattcaaatcttatatttttaataatgtcgaatcactcggagttgccaccttctgtgccaattgtgctgaatctatcacactaaaaaaaacatttcttcaaggtaatgacttgtggactatgttctgaattctcattaagtttttattttttgaagtttaagtttttaccttcttttttgaaaaatatcgttcataagatgtcacgccaggacatgagctacacatcacatattagcatgcagatgcggacgatttgtcactcacttcaaacacctaaaagagcttctctctcacagcacacacacatatgcatgcaatatttacacgtgatcgccatgcaaatctccattctcacctataaattagaggctcggcttcactttttactcaaaccaaaactcatcactacaagatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcaccattccaaacgaaatatcctcgagagtgtgtataccacggtgatatgagtgtggttgttgatgtatgttaacactacatagtcatggtgtgtgttccataaataatgtactaatgtaataagaactactccgtagacggtaataaaagagaagtttttttttttactcttgctactttcctataaagtgatgattaacaacagatacaccaaaaagaaaacaattaatctatattcacaatgaagcagtactagtctattgaacatgtcagattttctttttctagatgtctaatcaagccttcaaggctagtgataaaagatcatccaatgggatccaacaaagactcaaatctggttttgatcagatacttcgaaactatttttgtatgcactaaattatgcaagtgttcttttatttggtgaagactctttagaagcaaagaacgataagcagtaataaaaaaaataaagttcagttttaagatttgttattgacttagcggccgcttaattaaactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagttt

SEQ ID NO: 56 - DNA, 34850 bp, Artificial sequence
  plasmid pDAB109509
gtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcagatctgattggtaagatatgggtactgtttggtttatatgttttgactattcagtcactatggcccccataaattttaattcggctggtatgtctcggttaagaccggtttgacatggttcatttcagttcaattatgttaatctggcacgtgatatgtttaccttcacacgaacattagtaatgatgggctaatttaagacttaacaggcctagagaggcccatcttattacgtaacggcgtcgtttagagtgcaccaagcttataaatgaaaacgagctacctcgggacatcacgctctttgtacactccgccatctctctctctcgttggagcagatctctctcgtgaatatcgacaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcaccctatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctcaaattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagttt

SEQ ID NO: 57 - DNA, 35154 bp, Artificial sequence
  plasmid pDAB9151
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacaactttgtataataaagttgtctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 58 - DNA, 38074 bp, Artificial sequence
  plasmid pDAB108207
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcgaattcggcgcgccaaccttggactcccatgttggcaaaggcaaccaaacaaacaatgaatgatccgctcctgcatatggggcggtttgagtatttcaactgccatttgggctgaattgaagacatgctcctgtcagaaattccgtgatcttactcaatattcagtaatctcggccaatatcctaaatgtgcgtggctttatctgtctttgtattgtttcatcaattcatgtaacgtttgcttttcttatgaattttcaaataaattatcgatagtactacgaatatttcgtatcgctgatcttctcaatcacaatgatgcgtagtgacccgacaaataatttaagcgtccttaataccaatcctaaaataattgaggcaaataaaatttttttgtaatttttatgatagcagatcgattctccagcaagcctgcaacaaaatattgtgtatttctaaatagattttgatactcgaggtgaccgaattcgttggtagggtgctaggaaacttgtttttggggttttgtataagggttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaaatttcatatagtgttaaataataatttgttaaataaccaaaaagtcaaatatgtttactctcgtttaaataattgagattcgttccagcaaggctaaacgattgtatagatttatgacaatatttacttttttatagataaatgttatattataataaatttatatacatatattatatgttatttattatttattattattttaaatccttcaatattttatcaaaccaactcataattttttttttatctgtaagaagcaataaaattaaatagacccactttaaggatgatccaacctttatacagagtaagagagttcaaatagtaccttttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaagttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatactggtgacctaagtgattaagctaactactcagtaatgccagaacttgggctgccaaccaaaacccgcaacagccacagctgcaacacaattgtcatctggcacaagctccaacagagaccacgcaggagctgtttggagcttggcaggttctgttggggtgagtgctatctcgatctcttcaagtttggctattccatctcccgttgctttgagataagcctctttgcaagtccagtaacgaaagaaaatcttctgtttctgctcatcagggagtgacctcaagagttcatattctcttgggagaaagaacctctttgcaagagactccaagtcagatgttggacgcagatattcaagatcaatgcctatttgacgcgtgtagttgacagcacacaaggcaaggttctggctgtgagacaagttgaacaggagtccactctcagcaaatctgtcaccaaggatcggtttcccacgggactcataatcaaacttgacttgacccggttccactcccaagtatccacccaagatggatctgaggatgcctctcccagcagtgaaacgccttctgtgttctggaaagtagaatctgtttgccctcgccaattcatcactgctcagggtggcagcaaggtcttgaagttgtgactcaggctggtcaagaggaatcctccagagatgaacctcatctgacaagagggtcagattgggaggcttcggaagccaagtgtgctgaagcatttttggttgtggatcctagagtagtattgaatatgagttgggttggggtattatagtagtagagtagtagtactctggatggatggatgatgaaagaagtgagtgatattagaggtatttataggtattatataagagagaaggtggttggaacatgcatggagatttgggcatgggatgacacgcatatgcaggttgacgtgtgttgaagtgaagaaattgaggtggcggaagagaatgaatatatacaggtggttgtggtgatgatgaagaaaaaggcaatgtgtttgtgtgtgggttgagatgggtgagccatttaaagtgcatgttaagcacgtgttgctttgcatggcatttagacatacatggacgcggcgatcttgatcagccagtgactaatttgagttggttgtgtgattgcgttttgtctctctgttttgtcttttttctttgttctttgtctttttcttgcgcaagatccatgcatgaaccaaaagaccacagagtgtcatggcaacccacagtaattccagttacggacttacataccaagaaaaggtaaaagcaataagaaatatatgaaaattagtccaccataaatcttatagtttatggtttagggtaacactctaacactctactacattacttatatttactttaaactatctataaaacaatttaaacatagtagaataataaatcaatagtcacaaattcaacaattaaacttaaaattaaaaaagtaatattttaattatatctaattaattttttagaagtaatattgagtatttgatatatgaaatcttgaatatagtaactattattaaaattactttagaagatgtgtctcgcatgtaaaagcagatctaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtagcacatctgtactcactcaggtctagtggtcaggtcagattaattaagcggccgcgaattcggcgcgccaaccttggactcccatgttggcaaaggcaaccaaacaaacaatgaatgatccgctcctgcatatggggcggtttgagtatttcaactgccatttgggctgaattgaagacatgctcctgtcagaaattccgtgatcttactcaatattcagtaatctcggccaatatcctaaatgtgcgtggctttatctgtctttgtattgtttcatcaattcatgtaacgtttgcttttcttatgaattttcaaataaattatcgatagtactacgaatatttcgtatcgctgatcttctcaatcacaatgatgcgtagtgacccgacaaataatttaagcgtccttaataccaatcctaaaataattgaggcaaataaaatttttttgtaatttttatgatagcagatcgattctccagcaagcctgcaacaaaatattgtgtatttctaaatagattttgatactcgaggtcgacacaactttgtataataaagttgtctagacctagtagcacatctgtactcactcaggtctagtggtcaggtcagattaattaagcggccgcgaattcgttggtagggtgctaggaaacttgtttttggggttttgtataagggttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaaatttcatatagtgttaaataataatttgttaaataaccaaaaagtcaaatatgtttactctcgtttaaataattgagattcgttccagcaaggctaaacgattgtatagatttatgacaatatttacttttttatagataaatgttatattataataaatttatatacatatattatatgttatttattatttattattattttaaatccttcaatattttatcaaaccaactcataattttttttttatctgtaagaagcaataaaattaaatagacccactttaaggatgatccaacctttatacagagtaagagagttcaaatagtaccttttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaagttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatactggtgacctaagtgattaagctaactactcacagcttctcagcagggacatatgtgtcatcaatgctcgccacaagtgcagctgcaccatctgaaagccttgcatttctcagtatttcaagacgcctcaagaagcacgctcctctaagaatctgtttgttgatctgcacaacacacgggtactcatttgccactgccggatcaaggtaagttcctttgatgaaatcattgaatgaaccaatggcaggaccacaccaaacttggtagtccatgactctgtcagaagctccagtgttggcccaccttgaagccagggacagataccatctgaaacacagtgacatcttcagtttggggtccctctcagccctctgtatcttctctgggttgtggagacggttgatgtagaagttcttggtctcatcccagacctcttccaatgcacgactgaagattcttttctcaaccctcgcaagctctgctggaggcatggactcaaaagaatcatacttgcagaacaactcatagagtttgttggctcttgaagggaacattgttcctttcttcaaaacttgaagtttcacaccttcctcaaacatgtcagctgccggtgccatgcaaacatctgagtaagttgctttcgcaagctgtttcctcacattgtcacacgtcccagattgtttggcaacttggttcactgttccagtgacaatgaaagaggcacccatgttgaaagttgccagcgcagcttggggacacccaatgccacccccagcaccaacacgaaccctcaggtttgctgggtatccacactctctgtgaagcctatccctcaggttgataatcagaggcagaatgacatggattggacggttgtcagtgtgtccaccagaatcagcttcaaccgcaatgtcatcagccacaggaacacgtctggccaactcagcttgttcttgattgatctccccagaagcaatgagcttctgcaaaagatgctcaggtgcaggacgcatgaacatttcagccagctcagttctggagactttcccaatgattctgttccttatgttgactgacccatctgcattcctcgtcaacccagccgctctgtatctgacaacttgcggtgtcaacgtcatgaaggctgaagcctcaacaaaagtgacacccttttccaagaagagatcaacatttcccttctcaaggttgctgtcaaaaggagaatggatgaggttgacagcatatggtccattgggcagggcagcttgaatcttttcaatggactcacgcacaacttgcattggaaggcctccagcaccaaatgacgcaaggattccttgccttccagctgcgatcaccaagtccgcagaggcaattcccttggccattgcaccggtgtacagaggcgcagaaacaccataagttttcatgaaagctctgctgccaagatcagcaatgttgcacggagggacaatgacactggcatcagatggcgcagtctcaacaaggttgccagaagcacttgcagagctgagcgcaagcatggagtcaagatcaagcagggcactacgaagtgcatcagcactggcaacagcttttgtctccgcagctggggcagctttcttctgaactggagctgaaggagcaggagacggagatgaactgctggaagaggaactgctggaagagctggagctggaaggcgcattgtccttgttcaagatcggatctctggtctcatcttgctcatcaatgttgagacgcgcatagaatttcggagccacaggcttcatgatccttgaagagatggcagcttcaatcgcagggtccgcaggtgggaaggatgcaaggtctgctgaggagatggggtctgccttgctgttgaatctgccattcaactgaatctttctcacaaacttgtttttcttgggtttctcacctttacagagcgcagcataacaagcctcagcctctgcaacgagcttggagtggtagagcggactgatggtcactccaggaacaaggtgagccttcaatgaagccacgagcttgactattgtcgtccaagcatcctcgttctgcttgtctatggcaccagcaaggtggtttctctgtggtccaagcgtggttctcactgctgtgcttctgtgattgtttggcccaacttcaacaaacacatcatagttctgcttgtagatggtttcaactatctgagggaagttggcttgtttctcatagagctgtccagcatactccccaaaggatgaaggagcccattcatctttggcacccgtggctcttggcacaagcctcttctggtttatggtagtccagagatcaagaccatcaaccacagggaactcaaggttggcgtggatctttgcgatgtccttggtgtaaggtcccacctctgggcaatgcccacacatgccttgagtgactggaagcgcagggatgttgccaccaagacgagcaatcgcagctttgcatgcatcaggctttccactgatgagagcagtgttggcatcattgatgatggtcaacctcacatactttgagtctggtgctatggctgcttctatgtcttgtttcgttcccctcactatgtaaccttgccagaactcatcttttgggacagactgtggaatgccccaggcttctctgagcgcattgaactcaacagccagagctttgttccagacatctgactctctcaaatcctttgtcaactgatcgcttatcaaaccgtttttcttggagaaagcaaagatcatggaaatctctcccaaactgagtccaaaggctgctttgggcgtgatgttgagaacatctctcgccaggtttgtgaaggcaattgaggtgaggattccaagacggaacatttcaatcatgtttctgtcaaactcttgctgttgtgactcaagctcactcttgaagctggcccttggcatgacccatctgtcaccttcagcccagagacggtttgttttctcattgatgacctcatgaagttcaggccaaatcctatgaatgtcttgtgtgatgccatagtaagggctccttccttctccatacatgaaggcaactctgtcactggccaaaggctcaggcgcatatctgcttccagcaggggaactccaatcacgtctcatcttgagacatctcggaatgccttttgccgcaagttccacctctctctggagcttggatggagtggagaccaagctgagagcaaggggcttctgacttccagatgaagctgcatcttgggcaagggtctcaccaaggagttcaagaaagatcctacgggcttgcgccttcaattcagactctctgggtgcagcacccgtgggctgcaagaacctttcccttatcttgtccaatcttccaagaatctcttcatgggagtctgctctcaacacaatgagcttgggtgcttcctcatccaaactgattctgttctctctctcgtagtgtccctctgcttcagaaagcagcacactgtagcaacttctggtttcactgactccggaaacagccgcataacgtctctcaccagggttcttcaaccaagctcttgaggtctggcacgcaaagagtgtgctgtcccagggtgcttcaggtgcaggttcatcccagtcatctccattgctgggcaggtaacggttgtagatgcaaagcgcagccttaatcaaactggcagcaccagaagcataaccagtgtcaccaacagtggccttgacacttccagttgcaacattccttgggagcttgtcatcgtcacgaagaatcgtctgaagtccgccaatctcttcctcagcagtgagttcctttgggagaacagacgggtccttcaaatgcctcgctgaatcagcagaaagctccaacatctcgatgtctccaggcttgactctggcttgatccaatgcctctctcaaacatgcagatggaacatttccaggaactatggcatccatgcaagcatagattctgtcatccttggtgcagcttgtctcacgcttgagcacaaatgcaccacagccctctccaacaaagtaaccatcagcagctgcatcaaagctggctctcggggtgtcagatgtagacaccttgaaacgccttgacttgacgtaaaggttctcagcactcccacagagatcaacacccgcaaccacaaccccatcaacctctcccgtttccaagaggtatttgccaagttcagcacatctgtacacagaattgttgccttctgtgattgtgaaggaaggtcccgtgaagccccattgtgaactgacccttgttgcaaccaagttgcctatgtagctggtgtaagaagtgcttgtcccacaatcattgatgtactgcatcatgtcattgagtttcttgctggcttcaggcctcactctctccttgagagcaacccttgcacggtgacggtagagttcaagatcggtccccaaccccacaaagacagccacatttccacctttcttcatgccagagtccaatatggccctatcaattgtggtgacagccagaagctgttgaggcaagagcatatcttcaggagtcattggagtcctcagcctctggaaatcaacttcaacatcttcaatgtaacagccatgcggtgttgctttgactccacaaagatcaaggaagtccttgtctttccccaggaatctccatctcttttctgggagtggtatagcaccatgagcaccagtgtagatggccctttcaaaagcatccaatcctttcaaagcaccaaaagtggcatccatcccagtgattgctattctcatgtttgactcaccaccacaacgtgcagagagagcagaaatggagtcatggccagtgcatgcagcattgcttgggtcatgttcctcaaagacagcatgagcattggtcccaccaaatccaaacgctgagagaccagcacgcttcggttctccattcgtttctggccagggaatggcctcaccagagacaaccagagggtccatcttcgtttcgtcatctattcccggagtgggtggaatgatcccgtgcttcatggagagaagcactttgcacatgccagcaaacccagctgccaccaatgtgtgtccaaagttcccttttgtggttccaaaacgtgggactttgccttcaaagcaagccttcacagcatcaatttccacacgatcaccttgtggagtcccagttgcatggcattcaacatactgaatcttgtggggatgcacattgatacgtgtgtaggtgtccatgaggcactttttctctgacggcaaaaggggtttaagtggcagaccagtgccactgttgctgacattggctcccaaaagtgttccatagatgtgatctccatctctgattgcgtcatccaaacgtttgaggaccatgatggaacctccttcaccaggggtcaatccttgagaatctttgtgcagcggcatggacacattctgacccgttccaacaggcatggcttggaaggttgagaacccagagagtatgaaaaacggctccggcaggcatgttgcaccacaaagcatcacatcagctgcaccagagaccaagtgatcttgcgccagtctgagcacatagagcgcagtggcacaggcagcatcaacagagtagtggagagcgccaagattgagttcctcagcaacaaaggaagcagggtccatgaagattcttctgtcaccagcctctggtttgttggactgttctctttctgaccagtgagaggcatctttgaaaactctggcaccaagtttcttctcaacatggttctggtacacattcaagagttcaccttggaggttgtccatcgggaagctgaggcatccagaaactatgccacatcttgttgaatctttgacagatgtttcagccaaggcttgtttggcaaggttcaaaaggagttcatgctcattgtctatttcgttctcatcaagagttccatatgtctcattgcagaaggtgtcagcatacttgctcctttcagctttgtagtgttcagcacggtaatttgaaccaagacgtttgtcgctgatcactttgctctcaacttttccattcatgagaacttcccagaactcgtctttcgttttgcatccagcatactgaacagccatgcccacaacagctatcctcttctcgtcatgcatctcatgagccgcactcacgttccttgcagccatttttggttgtggatcctagagtagtattgaatatgagttgggttggggtattatagtagtagagtagtagtactctggatggatggatgatgaaagaagtgagtgatattagaggtatttataggtattatataagagagaaggtggttggaacatgcatggagatttgggcatgggatgacacgcatatgcaggttgacgtgtgttgaagtgaagaaattgaggtggcggaagagaatgaatatatacaggtggttgtggtgatgatgaagaaaaaggcaatgtgtttgtgtgtgggttgagatgggtgagccatttaaagtgcatgttaagcacgtgttgctttgcatggcatttagacatacatggacgcggcgatcttgatcagccagtgactaatttgagttggttgtgtgattgcgttttgtctctctgttttgtcttttttctttgttctttgtctttttcttgcgcaagatccatgcatgaaccaaaagaccacagagtgtcatggcaacccacagtaattccagttacggacttacataccaagaaaaggtaaaagcaataagaaatatatgaaaattagtccaccataaatcttatagtttatggtttagggtaacactctaacactctactacattacttatatttactttaaactatctataaaacaatttaaacatagtagaataataaatcaatagtcacaaattcaacaattaaacttaaaattaaaaaagtaatattttaattatatctaattaattttttagaagtaatattgagtatttgatatatgaaatcttgaatatagtaactattattaaaattactttagaagatgtgtctcgcatgtaaaagcagatctaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 59 - DNA, 36718 bp, Artificial sequence
  plasmid pDAB108208
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcatcagtaagtgcatataaagaaagtaataagtagatgagtttggtaattacatgagatcgacagaggaattacgacgttcttgccatcaaaaagagattccaaatttgtaaagagccatatgtttgttgggcaattgagattgagtcttgccaatccttctttggaagttgacaatttaaaaattcgaagccagatttactcctaattaattattgagcttgaagtcttaattaccgattacatctctgagcagtagtagtcgatgatctttcccggtcactaattttactcaagcgaatcgatttttactttagtttagctaaccgtacgccattacagtttagagagcagcaagggtaagaacattattaaaacataaagtaaacctctcatttattacggtgtagtgctaattacattagcctcaaacatcctaagcttacagttttataaaacacacacgatgactgtgtatagtattaacatacatcaatagcaacactcatgatcatcgtgctaggccgggcttggactgggtgacctaagtgattaagctaactactcagaacgcaagtgagtctgtcgcaatgacagaggcttgaacatcaatgaagagatcaccttgttcgttgtggaactgaagtgcatgtttgtgctggctatgtccaccactctgattggatctgagggtgatgtagaagggtttgtcttgtgggaccggtctgtgttggactatcctctgaatggagttcgggagtgcagcttgtcccagcgttctcctcacccagaccaacattgcttgaaaggcaagatcattgacaaagggatcatgtgcatcagtgtcagttgcaaactctcctctggctgcatctgatccaggaacagcagaacacttggcaacaagctggctcttggtgcagctgagaacgtcatcaatgcctctgaacgcaggaccatgaaagagagtcttgccatcatagactgacccttgcaaagcaggatctgcatcaaggctcggaggctgcatggttgcattggcaggtggagcaccttggttggacaacactatgacagctctgtaggctggaacaagttttccacttgagaacgtcttgagcgtcgcttggacattcaccctcccactcggagcagtggacggtgtgagggtcacttcacagttgacgtctccatcaacagtgacacctttgaagagctgtgcgtcatctatggcccagagagagtagccagggaagagtccaaggcaggtctcagcaaggctcccaatagcaagggtcattggcaacacccttctgccttgtatgacatgatcctccaagaagggattggacttggcactgatctttctatgcagggtgatcgtgtcacttccaactttcttggatggtgtcctccagtttccaacaaggatctcagcaggacttgatcccaacacaatcctcgcaactgtatcagcacctccttcacgaggaatgatctgaactcccatttcttgaaactgtttcttgagttgaggtgtcaccatcccaccatcccagggaccaaagcagatggacttgacactgacatccttcgcaagttccaaacccatcttgttgagagcttcgtttgccatcgcatagtcagactgaccaacattgccgtggaaaccagcaagggagctgaagagaaccatgtgtttgaggttggcacgatcaactgcagccagaagattctccaacccagtgactttggtcccaaagacagcatcaaactcgtcagggagtttcttctctatgagacgatcacggagcacaccagaagcgtgaacgattccactaactctggcaccaagctgggactctgcatccctaactgctttggcaacatctgcagcagagttcacatcacaagagctgtagatcgctttgccacccagagcttcaatggcagcaatggagcttctcacttcacgagcaccaagaacagatcccacaagtttcgtgacagcccttggagtgggtttgggtccttcaccagcactgaaggccctcttcaactcttgggtggcagctttctgcacagccttctcatcagtgatgccagcacaccatgctggttcagacgcagaaactttgctacgacccaacagaatgtacttgcctccagcaatctgacgcgtgatctcacggatgcaaagaggtgtgatcccacgagcacctccagaaaccagaagcacatcgtctttcgctatctgtctctgagggttcccagtctccaacttggcagctctgattgtgcatctttgctggtttgctccaatcccaacctctctgattctgatgtcagcacacgccatctccctaactatggcaactgcagcatcttctgggtgcatcccttgagcaatgtccacaccacggctgaacacatcagattctgaccactccaaccctattgtcttgcagagtccaaagatcgctccacgctgtgctctcttgagtgcgtcagaagtgccttgagaggtgaatccaagtctgccgtcaagcctagccacaccgatgaaggcaggacgacctccagccacagcagtgcagagagaggctttggcaaacttcgcacacatgagtgtgaaacccagtatctcagctggttcaaacctttctgcttgctggcttatgaagcctcccaacgctccaaatctttgctcagcctctttgatggccttctcagctgattctgctgaaaggtccttagccagaacatgacgaatggcagctgcaccagctctctgagccaactgcaatccctcaaaggtcaagacaactgcacaggctcccaacaccctcacaagagcaagtgtcaactctgagccatcgtcaacgacaagaactggacggttctccggtctttccagaatcagttcatctggccttctgatgtcaaccacctttgcgtgcatcagtgacaaatcgtcacagtcagcaccatgaactgaatcaatcttcacagctggtgcagcaccggcacttgcaggagcggctgcagccggagcaggggctgatccaccagctatctcagccttcatggcatcgaccacttctccaaccgttctggtccttgacaaagcatcgacatctttggcctcaacgttcagcatggcttgaacctcagaaaggatttccacacgcttgatgctatcaatcccaagctctgtttccaactccatgtctgactctatcatgtcagtctcgtatccagtctttgcagccaaaacctccatcacaacagtttcagctttttcaaggagttcgttgctgacagctggtgccgcggcagcgggagcaggagcggctgcagctggcgcaggagcagaacccccagctatctcagccttcatggcatcaaccacctctcccaccgtccttgttctggaaagagcatcaacatctttggcctccacattcaacatcgcttgaacctcagagaggatttcaacacgtttgatggagtcaattccaagctcggtctccagttccatgtcagattcaatcatgtcggtctcatagccagttttcgcagcaaggacttccatcacaactgtctcagccttttccaggagttctgaggagacggccggtgcggctgcagctggagccggtgccgcggctgcgggtgcaggagcggctgcagctggcgcaggcgcggaacttccagcgatctccgccttcatcgcatcaacgacctcaccaactgttctggtccttgagagggcatccacatccttagcctccacattgagcattgcttggacttcactgaggatctcaacacgcttgatgctgtcaatgcccaattccgtctcaagttccatgtcagactcaatcatgtcagtctcatagccggtttttgcagccagcacttccatgacaactgtttcagccttctcaagcaattcgttgctgacagctggtgccgcggctgcgggtgcaggtgcggcagctgccggcgcaggagcagagcctccagcaatctcagccttcatcgcatcgacaacttcccccacagttcttgtcctactgagtgcatcaacatctttagcctcaacgttgagcatggcttgcacctcagagaggatctccactctcttgatggaatctattccaagttcggtctccaattccatgtctgactcaatcatgtccgtttcgtaaccagtttttgcagcaaggacttccatcacaactgtttcggctttctccagcaactcattgctgacggcaggagcggctgcagctggagcaggtgccgcggcagcaggtgcaggtgcggctgcagctggcgcactagcagagcttccggcaatttcagccttcatggcgtccacgacctcaccgactgttctggttcttgaaagcgcatcgacatcttttgcctccacgttcaacatagcttggacctcagacaagatttcaacacgtttgatgctatctattcccaactcggtttcaagctccatgtcactttcaatcatgtcggtctcgtaaccagtcttagctgcgagcacctccatcacaaccgtctcggccttttccaggagttcggatgaaacagctggcgcgggcgcggccggtgctggtgcagctggagctggagctgcggctgccggtgcaggtgccgcggcagctggcgcaggcgcgctccctccagcaatctccgccttcatggcatccacaacctcacccactgtccttgttcttgaaagtgcatcaacatccttagcttcaacattgagcatggcttggacttcactcaggatctccactcttttgatggaatcgatcccaagctctgtctccaattccatatcagattcaatcatgtcggtctcatagccagtctttgcagccaaaacctccatcacaaccgtctcagccttctccaagagttctgaagaaacggcaggtgcaggtgcagctggagcaggtgccgcggctgcgggtgcaggagcggctgcagctggcgcgggcgcagaccctccagcaatttcagccttcatggcatccacaacctcaccaacggtcctcgttctggacagagcatcaacatccttcgcttccacgttcagcatagcttggacctcactgaggatttcaacacgtttgatgctgtctatcccaagttctgtctccaattccatgtcagactcaatcatgtcagtctcatagccggttttagctgccaagacctccatcacgacggtctcagctttttcaaggagttcgtttgagacggccggagcggctgcagctggagctggagccgcggcagcgggaccaggagcggcagcggccggcgcaggagcggagcctccagctatctcagccttcatggcattgacaacctcaccgacagttctggtccttgagagagcatccacatccttagcttccacattgagcatggcttggacttcactgaggatttccacacgcttgatggaatcaattccaagctccgtctcaagctccatgtctgattctatcatgtcagtttcgtagccagttttggcagcaaggacttccatcacaacagtttctgccttttcgagcagctcattagaaacagctggtgcagctgcagctggagccgctttagccggtgcaggtgcggcagctgccggcgccggagcggaagaaccagcgatttctgccttcatagcgttgacaacttcacccactgttctcgtcctagagagagcatcaacatctttcgcctcaacgttaagcatagcttggacttcagaaagaatttcaaccctcttgatgctgtcaattcccaactcagtctcaagctccatgtccgcctcaatcatgtctgtttcgtatccagtcttggcagcgagaacctccatcacaactgtctcagctttctcaagcaactcgttggacacggcgggagcaggagcacttgcaacgggagcggcaggggcagcggctttaacaggcgccggagcagtctgttgctgttgctgttgctgaagggaagaagcatcaacacttccataaccatccagctcagccagcatggacttgaggatggcacgatgtttctccacaacagcagtgtcaactgcaggcttggctgaagctgcagcagtcttggcttcctccttggcagcagcaagtttggagttggcttctgcagctgcacgtttggcgtcgtcaagctgcctctgagcgtcttgaagctccttctgaagcctttcagcctccctcttggcagcttcgtcaaccacaggttcaggagccttgatgagtggtgcagcacccttgaggtatgtgacacatcttccgtcgttcatggcagcatccctcactttcttggtcttgtcactgacataggtggcagctgaaagtctgagtgtggttctctttttcttgatggcttgcatcctcgtggcatcaggagcatcccacttgtcaaacccttgaagattgacaccagccacaaccagctgaactgcagcatccctcaactgtatgtcagagtccgtgccagaagctgggttcacagacactgtgacaacagacgggtcatctttgagggtttcagaaacaagtttgctgagaacttgtttcggtccaaactcaacaaagattctcgcaccagcttggtgcatgttcctcacttgggtcaggaacttcacagatgaggtcatgtgttgagtgagcatctctctggcatccgtcggataggtctctccagaaacattgctgaagagctttgtttctgctttgggtgtacggaaggaaaccttggatatgacatctttgaaagctgagctggcattttccatctgtggagaatggaaggcagactcacaagcaagaggcacaactctgaacccttccttctgcaatctggcactttcagcttgaatcccttcaacagacccagtaatgacagtctgagacggagagtttgagtttccaagccagacgttggcagcttgaaccttgatgttctctgcgttgggtcctatgacagctgccatgcaacctttgggtgtggcaggtgcatctttgcctcccatgatccttgcccttctgcaaacaagttcaaacaactcatctctgtcaacacaaccagctgcatagagcgcagcaaactcacccaagctgtgtccagctgcaaagtctggagtgaatccagcttccttgaaaatctcaaaggcaccaagagcacatgccagggttgacggctggctgtatgctgtgagtgagattttcttgtgatcttgttctggctcacgttcgtacggtttccttgggtacaggacttgagagactctttcaaagtctttgtcacttccagcaaccttggactgtgcagcgtccattgcagcaatggactgtctgaactgaggccagttcatcgcaacttcactgaacatgtgtgtgtactgagcaccttgtccagagaagagtgcagcaacagcaccattggtggcaatgcctttggcacggaaagaaactccttctctcggaagcctccacgcttctttggtcacatctttggcaaactgagcacatatagcacgaagcgtggagcacgcatcctccgcatctttgaccaagaatcccagtctcgcattggtcgcaggtatgctcccagggaacttgaactgttctccaaacttgacacacttgatgtaggcagtattcttgactgtctcattctccttgatcgcagcttcaaactctttcagctgagcttcacaaaggctctgcaacgcagcaggagttgcagccatcatcaacaccggttgtggacgtttgttgagtctgtacgctgtcgtgtgctctggttcagcctcttccaacactgcatggtagttggcacctccaaagccaaagctggatattccagcacgtctcggaacaccaggtggagggaaccagggtctgttcatcgtgttgatgtagagggatgactcattgatgggagtgttgtcatagagattgggtggattgtccacattgatcgttccaggcaaagtcttgtgtttgagagccatgatgaccttgatcattccagcaagaccagcaacagccttcaaatgaccaatactggacttgatacttccaactgcaactttctctgtgttcccttcaccatacgctttgtcaaacaagttcctcaacgcagtcaactcaatcctatctccaactggagtgccagtcccatgaccctcaaccaaagtgacagtggcagggtcaacgcaggcacgattgtatgcacgtctcaaggcttcctcttgaccactgattgtgggagtgtagatgccagctgctttgccatcacttgagcttgcacaaccacgaatcacagcatgaatctcatcaccatccctcactgcatctgcataacgtttgagcaccaacatggctgatccctcaccaatgagcatccctttcgttttctcatcatacgctctcacacttgggtccgtgctgaacacaggtgtctttgagaaagccatgtacatcccaatggagttgtctgtgcaggttgcaccagtgaccatcatgtcgcagtcaccatagagcagttcatcaatcgcaaccttgactgctatcaaggagcttgcacatgcagcatccacaacgcagttcatgccatccaagttgaatgtgttggtgcatctgccagcagtgacattcccaaggaatccagggaaagagtcaagtctccattctgggaagttcgctttgtacttctccacagccactttgacatcttcctctggcatccccatctttctcaagactttctccacaaccacatagttgagtctgctgtagaactcatgtgaactcttctgtccacctccaatgccaagcacgcatcctatgtttttcttctcctttccaagtgcatcaatcccagcatcttgaagtgcttctttgaccttgagaagtgagatggtctgattcgcatcagaatcttccatctggaacatgttgagaccaaactcacgcgcatcaaagtcatactcaggaatgaaacctcctctcttgcagtagattttgtcctttgtggtcttgactgggtcaaagtacgcagtcacatcaacacgatcctcaggaagatcagacaggcaatcaatgccagcccttatggtctcccatgactctctcaccgtggttccacaaggaagtatggcgctcatgcctatgatcgcaatcctcgtgtccatctcacctcctttctgctcttgcagcctcgctgccatttttggttgtggatccgttttgctatttgtgtatgttttcttgttttggtttgagtttaaccatcattctcttctctctatttatagagagaagaggttggcacgcagcactgcgacatgagagaaagacacgggtgaagaggcgggagctgaggtggcagcatgcatgcatgcatggccagtcgtgtcatagtgagaagaggagaaagctgaggtggcaacgtgtatggccagtggtgtcatagtgtgaaagctgacgtggcagcatgcatggtgagtgtgaaaaaggcgccacagtgcagatgttactgaacaaaagcggtgtgccatgcaacttttgcccatcgtcgtctttctcatccaagttcctctttataatatcttttaccaaatcatattttaatataaattcattttatttttaaataaagtaatattatatccataaatattaactctcatttaacacattttcaaatttaacacttctgtaaataaatttattaacaaaaacttgtaaatatgttcaaataaatccataaatattaactttcattttattaacaaaaaaatctttactataagctgcggccgcttaattaagatgagtgatactcaggactcaggactcactctgctgatcactagtgctagcctcgaggtcgacacaactttgtatacaaaagttgtctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcaccagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaactttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaaaggtactatttgaactctcttactctgtataaaggttggatcatccttaaagtgggtctatttaattttattgcttcttacagataaaaaaaaaattatgagttggtttgataaaatattgaaggatttaaaataataataaataataaataacatataatatatgtatataaatttattataatataacatttatctataaaaaagtaaatattgtcataaatctatacaatcgtttagccttgctggaacgaatctcaattatttaaacgagagtaaacatatttgactttttggttatttaacaaattattatttaacactatatgaaattttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaacccttatacaaaaccccaaaaacaagtttcctagcaccctaccaacgaattcggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaactactgtcactgaggccgtagacgagtacggactgatctaactagtgctagcctcgaggtcgaccaacttttctatacaaagttgtctagacctaggactaggcactgagtgactcactgacctgactgagtgactggcggccgcatcagtaagtgcatataaagaaagtaataagtagatgagtttggtaattacatgagatcgacagaggaattacgacgttcttgccatcaaaaagagattccaaatttgtaaagagccatatgtttgttgggcaattgagattgagtcttgccaatccttctttggaagttgacaatttaaaaattcgaagccagatttactcctaattaattattgagcttgaagtcttaattaccgattacatctctgagcagtagtagtcgatgatctttcccggtcactaattttactcaagcgaatcgatttttactttagtttagctaaccgtacgccattacagtttagagagcagcaagggtaagaacattattaaaacataaagtaaacctctcatttattacggtgtagtgctaattacattagcctcaaacatcctaagcttacagttttataaaacacacacgatgactgtgtatagtattaacatacatcaatagcaacactcatgatcatcgtgctaggccgggcttggactgggtgacctaagtgattaagctaactactcaaagcgcattcgttggctcatagacaaaggcagcatcttcagtctcaagatcaatcctcggatcatttctcagagcattaagacgcctcaggtaacatgcaccacgcaaaatctgaaggttgatctggacaacacatgggtactcattagagacagcaggatcaagatatgttcctttgatgaagtcattgaaggctccaatggctggaccacaccagacttgatagtccatgacacgatcaggagcacccatgttggcccaacgtgatgcaagaccaagataccatctgaaacacaaagacatcttgagtttggggtcatgttccgctctctgtatcttctctggattcttcaaaccattgatgtaaaagtccttggtctcttcccagacctcttgaagtgccctcttgaagatcctcttctcgatcctttcaagttcagcaggaggcattgaatcgaaagagtcgtacttgcaaaagagttcgtacaatttgttagctcttgatgggaacattgttcccttcttgagaacttggagtttcacaccttcctcaaacatatcagctgctggagccatgcaaatgtcactgtaggtggcttgactgagttgttttctcacgttgtcacatgtcccggactgtttagcaacttgattgacagtcccagtcactatgaaggcagctcccattgtgagggcagccgcagcagcttgtgggcagccaacaccgcctccagctccaactctgactctaaggtgcgcaggataaccacactctctgtgcagtctgttcctaaggttgatgatcaaaggcaagatgacgtggatgggacggttgtcagtgtgaccaccagaatcagcttcaacagcgatgtcgtctgcgacaggaacacgacgggcaagttcggcttgttcttgtgttatctcaccagaagctatgagtttctcaaggaggtgttccggagccggtctgatgaacatttcggcgagttctgttctggacacttttccaatgatacggtttctgatgttgacactcccatcagcgttccttgagagtccggctgcacggtaacgaacaacttggggagtgagggtcatgaatgcagaagcctccaccacagtaacgcccttttcgaggaagagatcaacattccccttttccaagttgctgtcaaaaggtgaatgaatgaggttcacagcatatggtccttgaggcagagccgcttgtatcttctccaaagctgccctcacatggtgcattggaagcccacccgctccaaaagaacccaatatcttcctcttcccagcagcaatgacaaggtccgcagacgcaattcccttggccattgctccagtgtacagaggtgctgacacattgtacgtttccatgaaggacttgtcaccaagatcacttatggagcatggtttgatactgacaatccttgaagaagttgcaggtttggattcaaactgcaccaaattggagttttcaacaccaagatacaatggattgtccacttcaagcaggacatctctcaactgagtcggactgagtgcaactccagttttcccagggtccgcttttgcgctgggtggctgttgttgaacatccggaatggcttgaggttttgcactgacaacacgaactctgagttctttggcttcatacacacggagaccatcaacccaaagtgctccatctgccactatgtcaacgtagcctccattttcaggagaggctgtgattgaaactatgtgcacctcacagtccatcgcacggttctttggtgtcaattgaccacggtacttccacgccgtttttccaggggcatgggcaaaggtcggattgctcacattgtattctcccggtatgttctggtccaccgcaaatgcctcaatgagctggaacattgactcaattcccaaagatccaggcatcacaggatcaaaccaaaagtgacaagagaagaaccagtcttgtgggttaacatctttgtgtccatgcgcatatcctttcccatgcagcccagaatcaggagcaatgttgaggtaatccaaatactcacactgttctgaccttctgagaacttgagcattagttgcatctggaagtttctcagtcagctgttctttgcctttggctgatgcgatttcaactcttctcacactcgtgttgttagttttgcaccaaggctccgtctttttcccattgtcaagtccagcttgctgagcaaacacctctggagtgaaccatccaaaggaagtgcttcctttgtagaaaaccacgccatcaacagacaactcaaacgtgaatctgtgaatccccatctttcccaacattgcatatccagtgcacttggtcacattccttatggttttccccctcacatccacatctggcctcaccatttcagcacttgcatcaaggttcctaaagagaatgtcatctttgtccatcgtcagtggtgctttcaacacactggtgagaacaccggatgtctgaagtccgatttccatgatgatggaataaggcatgtgcccatcattgcaagaaccatcaaagaaccacgcatcttgaggacagtcaaactcccccaccattgtgcctttgctgggattgcaatcaacattcaggaacttgccatgttccatgtttgtgacttcaacaactctagtcacaagagccaaatcaaaagcagggcttctgctcgtatttgacttatcaaatcttgcgaactctggtcccaagcagttgctaacttttccacacatgaactctgacatgttgtaccagttcagaggcatttctccagctttgcaattgttgtcaagtgggttgccagggaaagggatgaagcaaattgccctcggagggtaagaactaggggagaagaacggcgtcgggttgccaggaagttttgacatgggatgccaggacatttctttcggagcgagagcgtcacccttgaggatatgttcaggaagtgcaactggctttggcgcaagaacatctgctgagaaagcaggcttcgcaggggcagcagaagcactagcactggcaccagagctggccttggacgcttccggtcccacagtggctgcaccgttagcaaaaacgggctgaactttggaggggttcttgttcgtggatctcttctgcatcttgagagcaatgcccttgaagtccacgacgatctttttgttaagatccccctttccgtagtcgctgattctatcaaggctgaaatcttgacccttttcgaaatcaacgtcaatgatgttgacgtcagcaatggcgtacggatcgttatcctcgtcgaatcccatctctttgatctccatgacgtagaccaactttcccttatgaggagatatctgacccctacacctaactttgttcgggtgtccgttgacgggtctgaagtcaaatggtccggtggtaaggtgcaaaccgagccagatcatgtacatcttgagcatttgtgaacaaccgtcgctgacaagagatccagccatgacttgatccttaacaaaatggcatgggaagtaccaatggtccctctccaagattttctcaccaaccaactgacccaaaccgtacacacctcccttatggtcaatgctggtgactctatcaatcatgagcatcttacgtgcgcagagtttgtagttgatctccggcatgccattctttgagccaaaaacggaagcccaatctttgtcaaccaaggtctgcatctccttttcgttgagttttgttttgtgaaggcagggagcgacagcatagggagaaacatcttgctttggaatcttagctctggcagccaaatcccctcttgtgaacaccacaccctttcccgcatcaagctcctcatttgtgaagaagccagcacagccatctctcatctcaatgagaagcctcccattgacatagcagtcatactcaaagaagaacatggagatgccaccatccaaacgtttggcaaaaccggtcactctgatgtcatactcaagggtctctccctcatgggcaaccccatagaatgtcaacgtggtgttgagcagacggtaaactctgtcaccttggttctggaaatcaattcccatgtatgatatcagcatcaaatcgcactgtccactctcaaccagaactgcccagggacaatcacctccctcagacaattcgccattcactggaagatcatactcagtgaccattctggcaccaactctgtagttgttgacctcggcatccatgagtgtgacccttgtcacaagcaggtattcacgagcaggcagcctcacccttctggggtacttgtctatgacagcaaactccggaccaaaaaccttagctatgtcaccctctgcaaactccaggagttcctcatagttgaacacctcagttttgccagaggtcagttcctccttggtcatctcccaacatggcttcttgttggtcttgacacgaagcgccatttttggttgtggatccgttttgctatttgtgtatgttttcttgttttggtttgagtttaaccatcattctcttctctctatttatagagagaagaggttggcacgcagcactgcgacatgagagaaagacacgggtgaagaggcgggagctgaggtggcagcatgcatgcatgcatggccagtcgtgtcatagtgagaagaggagaaagctgaggtggcaacgtgtatggccagtggtgtcatagtgtgaaagctgacgtggcagcatgcatggtgagtgtgaaaaaggcgccacagtgcagatgttactgaacaaaagcggtgtgccatgcaacttttgcccatcgtcgtctttctcatccaagttcctctttataatatcttttaccaaatcatattttaatataaattcattttatttttaaataaagtaatattatatccataaatattaactctcatttaacacattttcaaatttaacacttctgtaaataaatttattaacaaaaacttgtaaatatgttcaaataaatccataaatattaactttcattttattaacaaaaaaatctttactataagctgcggccgcttaattaatcacgagtggatgactgtcacgactgactcatgactgactactagtgctagcctcgaggtcgacacaactttgtataataaagttgtctagtctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaatctgacctgaccactagacctgagtgagtacagatgtgctactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 60 - DNA, 36517 bp, Artificial sequence
  plasmid pDAB108209
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcatcagtaagtgcatataaagaaagtaataagtagatgagtttggtaattacatgagatcgacagaggaattacgacgttcttgccatcaaaaagagattccaaatttgtaaagagccatatgtttgttgggcaattgagattgagtcttgccaatccttctttggaagttgacaatttaaaaattcgaagccagatttactcctaattaattattgagcttgaagtcttaattaccgattacatctctgagcagtagtagtcgatgatctttcccggtcactaattttactcaagcgaatcgatttttactttagtttagctaaccgtacgccattacagtttagagagcagcaagggtaagaacattattaaaacataaagtaaacctctcatttattacggtgtagtgctaattacattagcctcaaacatcctaagcttacagttttataaaacacacacgatgactgtgtatagtattaacatacatcaatagcaacactcatgatcatcgtgctaggccgggcttggactgggtgacctaagtgattaagctaactactcagaacgcaagtgagtctgtcgcaatgacagaggcttgaacatcaatgaagagatcaccttgttcgttgtggaactgaagtgcatgtttgtgctggctatgtccaccactctgattggatctgagggtgatgtagaagggtttgtcttgtgggaccggtctgtgttggactatcctctgaatggagttcgggagtgcagcttgtcccagcgttctcctcacccagaccaacattgcttgaaaggcaagatcattgacaaagggatcatgtgcatcagtgtcagttgcaaactctcctctggctgcatctgatccaggaacagcagaacacttggcaacaagctggctcttggtgcagctgagaacgtcatcaatgcctctgaacgcaggaccatgaaagagagtcttgccatcatagactgacccttgcaaagcaggatctgcatcaaggctcggaggctgcatggttgcattggcaggtggagcaccttggttggacaacactatgacagctctgtaggctggaacaagttttccacttgagaacgtcttgagcgtcgcttggacattcaccctcccactcggagcagtggacggtgtgagggtcacttcacagttgacgtctccatcaacagtgacacctttgaagagctgtgcgtcatctatggcccagagagagtagccagggaagagtccaaggcaggtctcagcaaggctcccaatagcaagggtcattggcaacacccttctgccttgtatgacatgatcctccaagaagggattggacttggcactgatctttctatgcagggtgatcgtgtcacttccaactttcttggatggtgtcctccagtttccaacaaggatctcagcaggacttgatcccaacacaatcctcgcaactgtatcagcacctccttcacgaggaatgatctgaactcccatttcttgaaactgtttcttgagttgaggtgtcaccatcccaccatcccagggaccaaagcagatggacttgacactgacatccttcgcaagttccaaacccatcttgttgagagcttcgtttgccatcgcatagtcagactgaccaacattgccgtggaaaccagcaagggagctgaagagaaccatgtgtttgaggttggcacgatcaactgcagccagaagattctccaacccagtgactttggtcccaaagacagcatcaaactcgtcagggagtttcttctctatgagacgatcacggagcacaccagaagcgtgaacgattccactaactctggcaccaagctgggactctgcatccctaactgctttggcaacatctgcagcagagttcacatcacaagagctgtagatcgctttgccacccagagcttcaatggcagcaatggagcttctcacttcacgagcaccaagaacagatcccacaagtttcgtgacagcccttggagtgggtttgggtccttcaccagcactgaaggccctcttcaactcttgggtggcagctttctgcacagccttctcatcagtgatgccagcacaccatgctggttcagacgcagaaactttgctacgacccaacagaatgtacttgcctccagcaatctgacgcgtgatctcacggatgcaaagaggtgtgatcccacgagcacctccagaaaccagaagcacatcgtctttcgctatctgtctctgagggttcccagtctccaacttggcagctctgattgtgcatctttgctggtttgctccaatcccaacctctctgattctgatgtcagcacacgccatctccctaactatggcaactgcagcatcttctgggtgcatcccttgagcaatgtccacaccacggctgaacacatcagattctgaccactccaaccctattgtcttgcagagtccaaagatcgctccacgctgtgctctcttgagtgcgtcagaagtgccttgagaggtgaatccaagtctgccgtcaagcctagccacaccgatgaaggcaggacgacctccagccacagcagtgcagagagaggctttggcaaacttcgcacacatgagtgtgaaacccagtatctcagctggttcaaacctttctgcttgctggcttatgaagcctcccaacgctccaaatctttgctcagcctctttgatggccttctcagctgattctgctgaaaggtccttagccagaacatgacgaatggcagctgcaccagctctctgagccaactgcaatccctcaaaggtcaagacaactgcacaggctcccaacaccctcacaagagcaagtgtcaactctgagccatcgtcaacgacaagaactggacggttctccggtctttccagaatcagttcatctggccttctgatgtcaaccacctttgcgtgcatcagtgacaaatcgtcacagtcagcaccatgaactgaatcaatcttcacagctggtgcagcaccggcacttgcaggagcggctgcagccggagcaggggctgatccaccagctatctcagccttcatggcatcgaccacttctccaaccgttctggtccttgacaaagcatcgacatctttggcctcaacgttcagcatggcttgaacctcagaaaggatttccacacgcttgatgctatcaatcccaagctctgtttccaactccatgtctgactctatcatgtcagtctcgtatccagtctttgcagccaaaacctccatcacaacagtttcagctttttcaaggagttcgttgctgacagctggtgccgcggcagcgggagcaggagcggctgcagctggcgcaggagcagaacccccagctatctcagccttcatggcatcaaccacctctcccaccgtccttgttctggaaagagcatcaacatctttggcctccacattcaacatcgcttgaacctcagagaggatttcaacacgtttgatggagtcaattccaagctcggtctccagttccatgtcagattcaatcatgtcggtctcatagccagttttcgcagcaaggacttccatcacaactgtctcagccttttccaggagttctgaggagacggccggtgcggctgcagctggagccggtgccgcggctgcgggtgcaggagcggctgcagctggcgcaggcgcggaacttccagcgatctccgccttcatcgcatcaacgacctcaccaactgttctggtccttgagagggcatccacatccttagcctccacattgagcattgcttggacttcactgaggatctcaacacgcttgatgctgtcaatgcccaattccgtctcaagttccatgtcagactcaatcatgtcagtctcatagccggtttttgcagccagcacttccatgacaactgtttcagccttctcaagcaattcgttgctgacagctggtgccgcggctgcgggtgcaggtgcggcagctgccggcgcaggagcagagcctccagcaatctcagccttcatcgcatcgacaacttcccccacagttcttgtcctactgagtgcatcaacatctttagcctcaacgttgagcatggcttgcacctcagagaggatctccactctcttgatggaatctattccaagttcggtctccaattccatgtctgactcaatcatgtccgtttcgtaaccagtttttgcagcaaggacttccatcacaactgtttcggctttctccagcaactcattgctgacggcaggagcggctgcagctggagcaggtgccgcggcagcaggtgcaggtgcggctgcagctggcgcactagcagagcttccggcaatttcagccttcatggcgtccacgacctcaccgactgttctggttcttgaaagcgcatcgacatcttttgcctccacgttcaacatagcttggacctcagacaagatttcaacacgtttgatgctatctattcccaactcggtttcaagctccatgtcactttcaatcatgtcggtctcgtaaccagtcttagctgcgagcacctccatcacaaccgtctcggccttttccaggagttcggatgaaacagctggcgcgggcgcggccggtgctggtgcagctggagctggagctgcggctgccggtgcaggtgccgcggcagctggcgcaggcgcgctccctccagcaatctccgccttcatggcatccacaacctcacccactgtccttgttcttgaaagtgcatcaacatccttagcttcaacattgagcatggcttggacttcactcaggatctccactcttttgatggaatcgatcccaagctctgtctccaattccatatcagattcaatcatgtcggtctcatagccagtctttgcagccaaaacctccatcacaaccgtctcagccttctccaagagttctgaagaaacggcaggtgcaggtgcagctggagcaggtgccgcggctgcgggtgcaggagcggctgcagctggcgcgggcgcagaccctccagcaatttcagccttcatggcatccacaacctcaccaacggtcctcgttctggacagagcatcaacatccttcgcttccacgttcagcatagcttggacctcactgaggatttcaacacgtttgatgctgtctatcccaagttctgtctccaattccatgtcagactcaatcatgtcagtctcatagccggttttagctgccaagacctccatcacgacggtctcagctttttcaaggagttcgtttgagacggccggagcggctgcagctggagctggagccgcggcagcgggaccaggagcggcagcggccggcgcaggagcggagcctccagctatctcagccttcatggcattgacaacctcaccgacagttctggtccttgagagagcatccacatccttagcttccacattgagcatggcttggacttcactgaggatttccacacgcttgatggaatcaattccaagctccgtctcaagctccatgtctgattctatcatgtcagtttcgtagccagttttggcagcaaggacttccatcacaacagtttctgccttttcgagcagctcattagaaacagctggtgcagctgcagctggagccgctttagccggtgcaggtgcggcagctgccggcgccggagcggaagaaccagcgatttctgccttcatagcgttgacaacttcacccactgttctcgtcctagagagagcatcaacatctttcgcctcaacgttaagcatagcttggacttcagaaagaatttcaaccctcttgatgctgtcaattcccaactcagtctcaagctccatgtccgcctcaatcatgtctgtttcgtatccagtcttggcagcgagaacctccatcacaactgtctcagctttctcaagcaactcgttggacacggcgggagcaggagcacttgcaacgggagcggcaggggcagcggctttaacaggcgccggagcagtctgttgctgttgctgttgctgaagggaagaagcatcaacacttccataaccatccagctcagccagcatggacttgaggatggcacgatgtttctccacaacagcagtgtcaactgcaggcttggctgaagctgcagcagtcttggcttcctccttggcagcagcaagtttggagttggcttctgcagctgcacgtttggcgtcgtcaagctgcctctgagcgtcttgaagctccttctgaagcctttcagcctccctcttggcagcttcgtcaaccacaggttcaggagccttgatgagtggtgcagcacccttgaggtatgtgacacatcttccgtcgttcatggcagcatccctcactttcttggtcttgtcactgacataggtggcagctgaaagtctgagtgtggttctctttttcttgatggcttgcatcctcgtggcatcaggagcatcccacttgtcaaacccttgaagattgacaccagccacaaccagctgaactgcagcatccctcaactgtatgtcagagtccgtgccagaagctgggttcacagacactgtgacaacagacgggtcatctttgagggtttcagaaacaagtttgctgagaacttgtttcggtccaaactcaacaaagattctcgcaccagcttggtgcatgttcctcacttgggtcaggaacttcacagatgaggtcatgtgttgagtgagcatctctctggcatccgtcggataggtctctccagaaacattgctgaagagctttgtttctgctttgggtgtacggaaggaaaccttggatatgacatctttgaaagctgagctggcattttccatctgtggagaatggaaggcagactcacaagcaagaggcacaactctgaacccttccttctgcaatctggcactttcagcttgaatcccttcaacagacccagtaatgacagtctgagacggagagtttgagtttccaagccagacgttggcagcttgaaccttgatgttctctgcgttgggtcctatgacagctgccatgcaacctttgggtgtggcaggtgcatctttgcctcccatgatccttgcccttctgcaaacaagttcaaacaactcatctctgtcaacacaaccagctgcatagagcgcagcaaactcacccaagctgtgtccagctgcaaagtctggagtgaatccagcttccttgaaaatctcaaaggcaccaagagcacatgccagggttgacggctggctgtatgctgtgagtgagattttcttgtgatcttgttctggctcacgttcgtacggtttccttgggtacaggacttgagagactctttcaaagtctttgtcacttccagcaaccttggactgtgcagcgtccattgcagcaatggactgtctgaactgaggccagttcatcgcaacttcactgaacatgtgtgtgtactgagcaccttgtccagagaagagtgcagcaacagcaccattggtggcaatgcctttggcacggaaagaaactccttctctcggaagcctccacgcttctttggtcacatctttggcaaactgagcacatatagcacgaagcgtggagcacgcatcctccgcatctttgaccaagaatcccagtctcgcattggtcgcaggtatgctcccagggaacttgaactgttctccaaacttgacacacttgatgtaggcagtattcttgactgtctcattctccttgatcgcagcttcaaactctttcagctgagcttcacaaaggctctgcaacgcagcaggagttgcagccatcatcaacaccggttgtggacgtttgttgagtctgtacgctgtcgtgtgctctggttcagcctcttccaacactgcatggtagttggcacctccaaagccaaagctggatattccagcacgtctcggaacaccaggtggagggaaccagggtctgttcatcgtgttgatgtagagggatgactcattgatgggagtgttgtcatagagattgggtggattgtccacattgatcgttccaggcaaagtcttgtgtttgagagccatgatgaccttgatcattccagcaagaccagcaacagccttcaaatgaccaatactggacttgatacttccaactgcaactttctctgtgttcccttcaccatacgctttgtcaaacaagttcctcaacgcagtcaactcaatcctatctccaactggagtgccagtcccatgaccctcaaccaaagtgacagtggcagggtcaacgcaggcacgattgtatgcacgtctcaaggcttcctcttgaccactgattgtgggagtgtagatgccagctgctttgccatcacttgagcttgcacaaccacgaatcacagcatgaatctcatcaccatccctcactgcatctgcataacgtttgagcaccaacatggctgatccctcaccaatgagcatccctttcgttttctcatcatacgctctcacacttgggtccgtgctgaacacaggtgtctttgagaaagccatgtacatcccaatggagttgtctgtgcaggttgcaccagtgaccatcatgtcgcagtcaccatagagcagttcatcaatcgcaaccttgactgctatcaaggagcttgcacatgcagcatccacaacgcagttcatgccatccaagttgaatgtgttggtgcatctgccagcagtgacattcccaaggaatccagggaaagagtcaagtctccattctgggaagttcgctttgtacttctccacagccactttgacatcttcctctggcatccccatctttctcaagactttctccacaaccacatagttgagtctgctgtagaactcatgtgaactcttctgtccacctccaatgccaagcacgcatcctatgtttttcttctcctttccaagtgcatcaatcccagcatcttgaagtgcttctttgaccttgagaagtgagatggtctgattcgcatcagaatcttccatctggaacatgttgagaccaaactcacgcgcatcaaagtcatactcaggaatgaaacctcctctcttgcagtagattttgtcctttgtggtcttgactgggtcaaagtacgcagtcacatcaacacgatcctcaggaagatcagacaggcaatcaatgccagcccttatggtctcccatgactctctcaccgtggttccacaaggaagtatggcgctcatgcctatgatcgcaatcctcgtgtccatctcacctcctttctgctcttgcagcctcgctgccatttttggttgtggatccgttttgctatttgtgtatgttttcttgttttggtttgagtttaaccatcattctcttctctctatttatagagagaagaggttggcacgcagcactgcgacatgagagaaagacacgggtgaagaggcgggagctgaggtggcagcatgcatgcatgcatggccagtcgtgtcatagtgagaagaggagaaagctgaggtggcaacgtgtatggccagtggtgtcatagtgtgaaagctgacgtggcagcatgcatggtgagtgtgaaaaaggcgccacagtgcagatgttactgaacaaaagcggtgtgccatgcaacttttgcccatcgtcgtctttctcatccaagttcctctttataatatcttttaccaaatcatattttaatataaattcattttatttttaaataaagtaatattatatccataaatattaactctcatttaacacattttcaaatttaacacttctgtaaataaatttattaacaaaaacttgtaaatatgttcaaataaatccataaatattaactttcattttattaacaaaaaaatctttactataagctgcggccgcttaattaagatgagtgatactcaggactcaggactcactctgctgatcactagtgctagcctcgaggtcgacacaactttgtatacaaaagttgtctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaactactgtcactgaggccgtagacgagtacggactgatctaactagaaccggtgactactctacagccttggattaggcacggcatcgcgatctcttgggccgttgacttttaacttgcgatgacttttctaatttacgagtcaataaccattctccctcagatattgacttgttcgtagataagtgtcactttggaagctagcattacgagtacacgggtcggcaacttgcaaatcgtcgaaaattgctatgcaagttgatctctgatttggtagtacactcagctttgtgatcagccaatactcattacgtggtttattagcaaaatgaatcgacatgagccacagcgagtgacaccagttacgattccctcacaacctccgtctcgtgaaacgtaatagatcagcgttgtatgatgtaagatattgtagttttggatgtcaacgtagggtcgtgaagaggtttattaactcacatgttggaacccttagtgagttttcactttacaaatcacgcgtgccactacgtattacttcatcgtagatagggacaacacagaaacgaaagtgcgaaacctttacatcaccaggtcccaggcgagattcccaggggtgactaaaagtacgcatttgaaaactatgggggctattgaatctaaacatcagatagtcaccatgatcaatatccccgttacgcttgcttcgtaatctgggggagtagccgcttcccgcgcttacgagcgtgctcaagggccatacaaactgaccccagtgagccgttcagagtgcgtgccattgagaattggcgtacttctgttgaaaaaagtgcgataacgctcttcagggtggtcgataacccaagcgtagaatcacactttgcagaggatatgaggttcttaactaggatacttggggcgatcatcaagtaaggatgaagtcgcgtacgtactttctacatgctcagctaaagtgcaagcgggggacatgacgagatgattccaggaatcggggacattggcttagggcttatagatgtcttgttcgataacaccggtggatccccgggtaccgagctcgaattcctcgaccaacttttctatacaaagttgtctagacctaggactaggcactgagtgactcactgacctgactgagtgactggcggccgcatcagtaagtgcatataaagaaagtaataagtagatgagtttggtaattacatgagatcgacagaggaattacgacgttcttgccatcaaaaagagattccaaatttgtaaagagccatatgtttgttgggcaattgagattgagtcttgccaatccttctttggaagttgacaatttaaaaattcgaagccagatttactcctaattaattattgagcttgaagtcttaattaccgattacatctctgagcagtagtagtcgatgatctttcccggtcactaattttactcaagcgaatcgatttttactttagtttagctaaccgtacgccattacagtttagagagcagcaagggtaagaacattattaaaacataaagtaaacctctcatttattacggtgtagtgctaattacattagcctcaaacatcctaagcttacagttttataaaacacacacgatgactgtgtatagtattaacatacatcaatagcaacactcatgatcatcgtgctaggccgggcttggactgggtgacctaagtgattaagctaactactcaaagcgcattcgttggctcatagacaaaggcagcatcttcagtctcaagatcaatcctcggatcatttctcagagcattaagacgcctcaggtaacatgcaccacgcaaaatctgaaggttgatctggacaacacatgggtactcattagagacagcaggatcaagatatgttcctttgatgaagtcattgaaggctccaatggctggaccacaccagacttgatagtccatgacacgatcaggagcacccatgttggcccaacgtgatgcaagaccaagataccatctgaaacacaaagacatcttgagtttggggtcatgttccgctctctgtatcttctctggattcttcaaaccattgatgtaaaagtccttggtctcttcccagacctcttgaagtgccctcttgaagatcctcttctcgatcctttcaagttcagcaggaggcattgaatcgaaagagtcgtacttgcaaaagagttcgtacaatttgttagctcttgatgggaacattgttcccttcttgagaacttggagtttcacaccttcctcaaacatatcagctgctggagccatgcaaatgtcactgtaggtggcttgactgagttgttttctcacgttgtcacatgtcccggactgtttagcaacttgattgacagtcccagtcactatgaaggcagctcccattgtgagggcagccgcagcagcttgtgggcagccaacaccgcctccagctccaactctgactctaaggtgcgcaggataaccacactctctgtgcagtctgttcctaaggttgatgatcaaaggcaagatgacgtggatgggacggttgtcagtgtgaccaccagaatcagcttcaacagcgatgtcgtctgcgacaggaacacgacgggcaagttcggcttgttcttgtgttatctcaccagaagctatgagtttctcaaggaggtgttccggagccggtctgatgaacatttcggcgagttctgttctggacacttttccaatgatacggtttctgatgttgacactcccatcagcgttccttgagagtccggctgcacggtaacgaacaacttggggagtgagggtcatgaatgcagaagcctccaccacagtaacgcccttttcgaggaagagatcaacattccccttttccaagttgctgtcaaaaggtgaatgaatgaggttcacagcatatggtccttgaggcagagccgcttgtatcttctccaaagctgccctcacatggtgcattggaagcccacccgctccaaaagaacccaatatcttcctcttcccagcagcaatgacaaggtccgcagacgcaattcccttggccattgctccagtgtacagaggtgctgacacattgtacgtttccatgaaggacttgtcaccaagatcacttatggagcatggtttgatactgacaatccttgaagaagttgcaggtttggattcaaactgcaccaaattggagttttcaacaccaagatacaatggattgtccacttcaagcaggacatctctcaactgagtcggactgagtgcaactccagttttcccagggtccgcttttgcgctgggtggctgttgttgaacatccggaatggcttgaggttttgcactgacaacacgaactctgagttctttggcttcatacacacggagaccatcaacccaaagtgctccatctgccactatgtcaacgtagcctccattttcaggagaggctgtgattgaaactatgtgcacctcacagtccatcgcacggttctttggtgtcaattgaccacggtacttccacgccgtttttccaggggcatgggcaaaggtcggattgctcacattgtattctcccggtatgttctggtccaccgcaaatgcctcaatgagctggaacattgactcaattcccaaagatccaggcatcacaggatcaaaccaaaagtgacaagagaagaaccagtcttgtgggttaacatctttgtgtccatgcgcatatcctttcccatgcagcccagaatcaggagcaatgttgaggtaatccaaatactcacactgttctgaccttctgagaacttgagcattagttgcatctggaagtttctcagtcagctgttctttgcctttggctgatgcgatttcaactcttctcacactcgtgttgttagttttgcaccaaggctccgtctttttcccattgtcaagtccagcttgctgagcaaacacctctggagtgaaccatccaaaggaagtgcttcctttgtagaaaaccacgccatcaacagacaactcaaacgtgaatctgtgaatccccatctttcccaacattgcatatccagtgcacttggtcacattccttatggttttccccctcacatccacatctggcctcaccatttcagcacttgcatcaaggttcctaaagagaatgtcatctttgtccatcgtcagtggtgctttcaacacactggtgagaacaccggatgtctgaagtccgatttccatgatgatggaataaggcatgtgcccatcattgcaagaaccatcaaagaaccacgcatcttgaggacagtcaaactcccccaccattgtgcctttgctgggattgcaatcaacattcaggaacttgccatgttccatgtttgtgacttcaacaactctagtcacaagagccaaatcaaaagcagggcttctgctcgtatttgacttatcaaatcttgcgaactctggtcccaagcagttgctaacttttccacacatgaactctgacatgttgtaccagttcagaggcatttctccagctttgcaattgttgtcaagtgggttgccagggaaagggatgaagcaaattgccctcggagggtaagaactaggggagaagaacggcgtcgggttgccaggaagttttgacatgggatgccaggacatttctttcggagcgagagcgtcacccttgaggatatgttcaggaagtgcaactggctttggcgcaagaacatctgctgagaaagcaggcttcgcaggggcagcagaagcactagcactggcaccagagctggccttggacgcttccggtcccacagtggctgcaccgttagcaaaaacgggctgaactttggaggggttcttgttcgtggatctcttctgcatcttgagagcaatgcccttgaagtccacgacgatctttttgttaagatccccctttccgtagtcgctgattctatcaaggctgaaatcttgacccttttcgaaatcaacgtcaatgatgttgacgtcagcaatggcgtacggatcgttatcctcgtcgaatcccatctctttgatctccatgacgtagaccaactttcccttatgaggagatatctgacccctacacctaactttgttcgggtgtccgttgacgggtctgaagtcaaatggtccggtggtaaggtgcaaaccgagccagatcatgtacatcttgagcatttgtgaacaaccgtcgctgacaagagatccagccatgacttgatccttaacaaaatggcatgggaagtaccaatggtccctctccaagattttctcaccaaccaactgacccaaaccgtacacacctcccttatggtcaatgctggtgactctatcaatcatgagcatcttacgtgcgcagagtttgtagttgatctccggcatgccattctttgagccaaaaacggaagcccaatctttgtcaaccaaggtctgcatctccttttcgttgagttttgttttgtgaaggcagggagcgacagcatagggagaaacatcttgctttggaatcttagctctggcagccaaatcccctcttgtgaacaccacaccctttcccgcatcaagctcctcatttgtgaagaagccagcacagccatctctcatctcaatgagaagcctcccattgacatagcagtcatactcaaagaagaacatggagatgccaccatccaaacgtttggcaaaaccggtcactctgatgtcatactcaagggtctctccctcatgggcaaccccatagaatgtcaacgtggtgttgagcagacggtaaactctgtcaccttggttctggaaatcaattcccatgtatgatatcagcatcaaatcgcactgtccactctcaaccagaactgcccagggacaatcacctccctcagacaattcgccattcactggaagatcatactcagtgaccattctggcaccaactctgtagttgttgacctcggcatccatgagtgtgacccttgtcacaagcaggtattcacgagcaggcagcctcacccttctggggtacttgtctatgacagcaaactccggaccaaaaaccttagctatgtcaccctctgcaaactccaggagttcctcatagttgaacacctcagttttgccagaggtcagttcctccttggtcatctcccaacatggcttcttgttggtcttgacacgaagcgccatttttggttgtggatccgttttgctatttgtgtatgttttcttgttttggtttgagtttaaccatcattctcttctctctatttatagagagaagaggttggcacgcagcactgcgacatgagagaaagacacgggtgaagaggcgggagctgaggtggcagcatgcatgcatgcatggccagtcgtgtcatagtgagaagaggagaaagctgaggtggcaacgtgtatggccagtggtgtcatagtgtgaaagctgacgtggcagcatgcatggtgagtgtgaaaaaggcgccacagtgcagatgttactgaacaaaagcggtgtgccatgcaacttttgcccatcgtcgtctttctcatccaagttcctctttataatatcttttaccaaatcatattttaatataaattcattttatttttaaataaagtaatattatatccataaatattaactctcatttaacacattttcaaatttaacacttctgtaaataaatttattaacaaaaacttgtaaatatgttcaaataaatccataaatattaactttcattttattaacaaaaaaatctttactataagctgcggccgcttaattaatcacgagtggatgactgtcacgactgactcatgactgactactagtgctagcctcgaggtcgacacaactttgtataataaagttgtctagtctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaatctgacctgaccactagacctgagtgagtacagatgtgctactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 61 - DNA, 36590 bp, Artificial sequence
  plasmid pDAB9159
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacctttaaacggtcgcagcgtgtgcgtgtccgtcgtacgttctggccggccgggccttgggcgcgcgatcagaagcgttgcgttggcgtgtgtgtgcttctggtttgctttaattttaccaagtttgtttcaaggtggatcgcgtggtcaaggcccgtgtgctttaaagacccaccggcactggcagtgagtgttgctgcttgtgtaggctttggtacgtatgggctttatttgcttctggatgttgtgtactacttgggtttgttgaattattatgagcagttgcgtattgtaattcagctgggctacctggacattgttatgtattaataaatgctttgctttcttctaaagatctttaagtgctcggccggccttggccacggtggccagatccactagaggcgcgcctctagtgcggccgcttaattaagatgagtgatactcaggactcaggactcactctgctgatcactagtgctagcctcgaggtcgacacaactttgtatacaaaagttgtctagacctaggctcagcaactcatccagtcaagttcgagtcagtgagttgggcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacctttaaacggtcgcagcgtgtgcgtgtccgtcgtacgttctggccggccgggccttgggcgcgcgatcagaagcgttgcgttggcgtgtgtgtgcttctggtttgctttaattttaccaagtttgtttcaaggtggatcgcgtggtcaaggcccgtgtgctttaaagacccaccggcactggcagtgagtgttgctgcttgtgtaggctttggtacgtatgggctttatttgcttctggatgttgtgtactacttgggtttgttgaattattatgagcagttgcgtattgtaattcagctgggctacctggacattgttatgtattaataaatgctttgctttcttctaaagatctttaagtgctcggccggccttggccacggtggccagatccactagaggcgcgcctctagtgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacctttaaacggtcgcagcgtgtgcgtgtccgtcgtacgttctggccggccgggccttgggcgcgcgatcagaagcgttgcgttggcgtgtgtgtgcttctggtttgctttaattttaccaagtttgtttcaaggtggatcgcgtggtcaaggcccgtgtgctttaaagacccaccggcactggcagtgagtgttgctgcttgtgtaggctttggtacgtatgggctttatttgcttctggatgttgtgtactacttgggtttgttgaattattatgagcagttgcgtattgtaattcagctgggctacctggacattgttatgtattaataaatgctttgctttcttctaaagatctttaagtgctcggccggccttggccacggtggccagatccactagaggcgcgcctctagtgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcctcccagtatcattatagtgaaagttttggctctctcgccggtggttttttacctctatttaaaggggttttccacctaaaaattctggtatcattctcactttacttgttactttaatttctcataatctttggttgaaattatcacgcttccgcacacgatatccctacaaatttattatttgttaaacattttcaaaccgcataaaattttatgaagtcccgtctatctttaatgtagtctaacattttcatattgaaatatataatttacttaattttagcgttggtagaaagcataatgatttattcttattcttcttcatataaatgtttaatatacaatataaacaaattctttaccttaagaaggatttcccattttatattttaaaaatatatttatcaaatatttttcaaccacgtaaatctcataataataagttgtttcaaaagtaataaaatttaactccataatttttttattcgactgatcttaaagcaacacccagtgacacaactagccatttttttctttgaataaaaaaatccaattatcattgtattttttttatacaatgaaaatttcaccaaacaatgatttgtggtatttctgaagcaagtcatgttatgcaaaattctataattcccatttgacactacggaagtaactgaagatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacctttaaacggtcgcagcgtgtgcgtgtccgtcgtacgttctggccggccgggccttgggcgcgcgatcagaagcgttgcgttggcgtgtgtgtgcttctggtttgctttaattttaccaagtttgtttcaaggtggatcgcgtggtcaaggcccgtgtgctttaaagacccaccggcactggcagtgagtgttgctgcttgtgtaggctttggtacgtatgggctttatttgcttctggatgttgtgtactacttgggtttgttgaattattatgagcagttgcgtattgtaattcagctgggctacctggacattgttatgtattaataaatgctttgctttcttctaaagatctttaagtgctcggccggccttggccacggtggccagatccactagaggcgcgcctctagtgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 62 - DNA, 35499 bp, Artificial sequence
  plasmid pDAB9147
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggtggagtcatcacgcagactatctcagcatgtgcgtagcacgcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcagcgaggctgcaagagcagaaaggaggtgagatggacacgaggattgcgatcataggcatgagcgccatacttccttgtggaaccacggtgagagagtcatgggagaccataagggctggcattgattgcctgtctgatcttcctgaggatcgtgttgatgtgactgcgtactttgacccagtcaagaccacaaaggacaaaatctactgcaagagaggaggtttcattcctgagtatgactttgatgcgcgtgagtttggtctcaacatgttccagatggaagattctgatgcgaatcagaccatctcacttctcaaggtcaaagaagcacttcaagatgctgggattgatgcacttggaaaggagaagaaaaacataggatgcgtgcttggcattggaggtggacagaagagttcacatgagttctacagcagactcaactatgtggttgtggagaaagtcttgagaaagatggggatgccagaggaagatgtcaaagtggctgtggagaagtacaaagcgaacttcccagaatggagacttgactctttccctggattccttgggaatgtcactgctggcagatgcaccaacacattcaacttggatggcatgaactgcgttgtggatgctgcatgtgcaagctccttgatagcagtcaaggttgcgattgatgaactgctctatggtgactgcgacatgatggtcactggtgcaacctgcacagacaactccattgggatgtacatggctttctcaaagacacctgtgttcagcacggacccaagtgtgagagcgtatgatgagaaaacgaaagggatgctcattggtgagggatcagccatgttggtgctcaaacgttatgcagatgcagtgagggatggtgatgagattcatgctgtgattcgtggttgtgcaagctcaagtgatggcaaagcagctggcatctacactcccacaatcagtggtcaagaggaagccttgagacgtgcatacaatcgtgcctgcgttgaccctgccactgtcactttggttgagggtcatgggactggcactccagttggagataggattgagttgactgcgttgaggaacttgtttgacaaagcgtatggtgaagggaacacagagaaagttgcagttggaagtatcaagtccagtattggtcatttgaaggctgttgctggtcttgctggaatgatcaaggtcatcatggctctcaaacacaagactttgcctggaacgatcaatgtggacaatccacccaatctctatgacaacactcccatcaatgagtcatccctctacatcaacacgatgaacagaccctggttccctccacctggtgttccgagacgtgctggaatatccagctttggctttggaggtgccaactaccatgcagtgttggaagaggctgaaccagagcacacgacagcgtacagactcaacaaacgtccacaaccggtgttgatgatggctgcaactcctgctgcgttgcagagcctttgtgaagctcagctgaaagagtttgaagctgcgatcaaggagaatgagacagtcaagaatactgcctacatcaagtgtgtcaagtttggagaacagttcaagttccctgggagcatacctgcgaccaatgcgagactgggattcttggtcaaagatgcggaggatgcgtgctccacgcttcgtgctatatgtgctcagtttgccaaagatgtgaccaaagaagcgtggaggcttccgagagaaggagtttctttccgtgccaaaggcattgccaccaatggtgctgttgctgcactcttctctggacaaggtgctcagtacacacacatgttcagtgaagttgcgatgaactggcctcagttcagacagtccattgctgcaatggacgctgcacagtccaaggttgctggaagtgacaaagactttgaaagagtctctcaagtcctgtacccaaggaaaccgtacgaacgtgagccagaacaagatcacaagaaaatctcactcacagcatacagccagccgtcaaccctggcatgtgctcttggtgcctttgagattttcaaggaagctggattcactccagactttgcagctggacacagcttgggtgagtttgctgcgctctatgcagctggttgtgttgacagagatgagttgtttgaacttgtttgcagaagggcaaggatcatgggaggcaaagatgcacctgccacacccaaaggttgcatggcagctgtcataggacccaacgcagagaacatcaaggttcaagctgccaacgtctggcttggaaactcaaactctccgtctcagactgtcattactgggtctgttgaagggattcaagctgaaagtgccagattgcagaaggaagggttcagagttgtgcctcttgcttgtgagtctgccttccattctccacagatggaaaatgccagctcagctttcaaagatgtcatatccaaggtttccttccgtacacccaaagcagaaacaaagctcttcagcaatgtttctggagagacctatccgacggatgccagagagatgctcactcaacacatgacctcatctgtgaagttcctgacccaagtgaggaacatgcaccaagctggtgcgagaatctttgttgagtttggaccgaaacaagttctcagcaaacttgtttctgaaaccctcaaagatgacccgtctgttgtcacagtgtctgtgaacccagcttctggcacggactctgacatacagttgagggatgctgcagttcagctggttgtggctggtgtcaatcttcaagggtttgacaagtgggatgctcctgatgccacgaggatgcaagccatcaagaaaaagagaaccacactcagactttcagctgccacctatgtcagtgacaagaccaagaaagtgagggatgctgccatgaacgacggaagatgtgtcacatacctcaagggtgctgcaccactcatcaaggctcctgaacctgtggttgacgaagctgccaagagggaggctgaaaggcttcagaaggagcttcaagacgctcagaggcagcttgacgacgccaaacgtgcagctgcagaagccaactccaaacttgctgctgccaaggaggaagccaagactgctgcagcttcagccaagcctgcagttgacactgctgttgtggagaaacatcgtgccatcctcaagtccatgctggctgagctggatggttatggaagtgttgatgcttcttcccttcagcaacagcaacagcaacagactgctccggcgcctgttaaagccgctgcccctgccgctcccgttgcaagtgctcctgctcccgccgtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttccgctccggcgccggcagctgccgcacctgcaccggctaaagcggctccagctgcagctgcaccagctgtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctccgctcctgcgccggccgctgccgctcctggtcccgctgccgcggctccagctccagctgcagccgctccggccgtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtctgcgcccgcgccagctgcagccgctcctgcacccgcagccgcggcacctgctccagctgcacctgcacctgccgtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagcgcgcctgcgccagctgccgcggcacctgcaccggcagccgcagctccagctccagctgcaccagcaccggccgcgcccgcgccagctgtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctctgctagtgcgccagctgcagccgcacctgcacctgctgccgcggcacctgctccagctgcagccgctcctgccgtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctctgctcctgcgccggcagctgccgcacctgcacccgcagccgcggcaccagctgtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttccgcgcctgcgccagctgcagccgctcctgcacccgcagccgcggcaccggctccagctgcagccgcaccggccgtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttctgctcctgcgccagctgcagccgctcctgctcccgctgccgcggcaccagctgtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatcagcccctgctccggctgcagccgctcctgcaagtgccggtgctgcaccagctgtgaagattgattcagttcatggtgctgactgtgacgatttgtcactgatgcacgcaaaggtggttgacatcagaaggccagatgaactgattctggaaagaccggagaaccgtccagttcttgtcgttgacgatggctcagagttgacacttgctcttgtgagggtgttgggagcctgtgcagttgtcttgacctttgagggattgcagttggctcagagagctggtgcagctgccattcgtcatgttctggctaaggacctttcagcagaatcagctgagaaggccatcaaagaggctgagcaaagatttggagcgttgggaggcttcataagccagcaagcagaaaggtttgaaccagctgagatactgggtttcacactcatgtgtgcgaagtttgccaaagcctctctctgcactgctgtggctggaggtcgtcctgccttcatcggtgtggctaggcttgacggcagacttggattcacctctcaaggcacttctgacgcactcaagagagcacagcgtggagcgatctttggactctgcaagacaatagggttggagtggtcagaatctgatgtgttcagccgtggtgtggacattgctcaagggatgcacccagaagatgctgcagttgccatagttagggagatggcgtgtgctgacatcagaatcagagaggttgggattggagcaaaccagcaaagatgcacaatcagagctgccaagttggagactgggaaccctcagagacagatagcgaaagacgatgtgcttctggtttctggaggtgctcgtgggatcacacctctttgcatccgtgagatcacgcgtcagattgctggaggcaagtacattctgttgggtcgtagcaaagtttctgcgtctgaaccagcatggtgtgctggcatcactgatgagaaggctgtgcagaaagctgccacccaagagttgaagagggccttcagtgctggtgaaggacccaaacccactccaagggctgtcacgaaacttgtgggatctgttcttggtgctcgtgaagtgagaagctccattgctgccattgaagctctgggtggcaaagcgatctacagctcttgtgatgtgaactctgctgcagatgttgccaaagcagttagggatgcagagtcccagcttggtgccagagttagtggaatcgttcacgcttctggtgtgctccgtgatcgtctcatagagaagaaactccctgacgagtttgatgctgtctttgggaccaaagtcactgggttggagaatcttctggctgcagttgatcgtgccaacctcaaacacatggttctcttcagctcccttgctggtttccacggcaatgttggtcagtctgactatgcgatggcaaacgaagctctcaacaagatgggtttggaacttgcgaaggatgtcagtgtcaagtccatctgctttggtccctgggatggtgggatggtgacacctcaactcaagaaacagtttcaagaaatgggagttcagatcattcctcgtgaaggaggtgctgatacagttgcgaggattgtgttgggatcaagtcctgctgagatccttgttggaaactggaggacaccatccaagaaagttggaagtgacacgatcaccctgcatagaaagatcagtgccaagtccaatcccttcttggaggatcatgtcatacaaggcagaagggtgttgccaatgacccttgctattgggagccttgctgagacctgccttggactcttccctggctactctctctgggccatagatgacgcacagctcttcaaaggtgtcactgttgatggagacgtcaactgtgaagtgaccctcacaccgtccactgctccgagtgggagggtgaatgtccaagcgacgctcaagacgttctcaagtggaaaacttgttccagcctacagagctgtcatagtgttgtccaaccaaggtgctccacctgccaatgcaaccatgcagcctccgagccttgatgcagatcctgctttgcaagggtcagtctatgatggcaagactctctttcatggtcctgcgttcagaggcattgatgacgttctcagctgcaccaagagccagcttgttgccaagtgttctgctgttcctggatcagatgcagccagaggagagtttgcaactgacactgatgcacatgatccctttgtcaatgatcttgcctttcaagcaatgttggtctgggtgaggagaacgctgggacaagctgcactcccgaactccattcagaggatagtccaacacagaccggtcccacaagacaaacccttctacatcaccctcagatccaatcagagtggtggacatagccagcacaaacatgcacttcagttccacaacgaacaaggtgatctcttcattgatgttcaagcctctgtcattgcgacagactcacttgcgttctgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaagatgagtgatactcaggactcaggactcactctgctgatcactagtggtcgcagcgtgtgcgtgtccgtcgtacgttctggccggccgggccttgggcgcgcgatcagaagcgttgcgttggcgtgtgtgtgcttctggtttgctttaattttaccaagtttgtttcaaggtggatcgcgtggtcaaggcccgtgtgctttaaagacccaccggcactggcagtgagtgttgctgcttgtgtaggctttggtacgtatgggctttatttgcttctggatgttgtgtactacttgggtttgttgaattattatgagcagttgcgtattgtaattcagctgggctacctggacattgttatgtattaataaatgctttgctttcttctaaagatctttaagtgctgtcgacacaactttgtatacaaaagttgtctagacctaggctcagcaactcatccagtcaagttcgagtcagtgagttgggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatctgacctgaccactagacctgagtgagtacagatgtgctactagtgctagcctcgaggtcgaccaacttttctatacaaagttgtctagacctaggactaggcactgagtgactcactgacctgactgagtgactggcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatggcgcttcgtgtcaagaccaacaagaagccatgttgggagatgaccaaggaggaactgacctctggcaaaactgaggtgttcaactatgaggaactcctggagtttgcagagggtgacatagctaaggtttttggtccggagtttgctgtcatagacaagtaccccagaagggtgaggctgcctgctcgtgaatacctgcttgtgacaagggtcacactcatggatgccgaggtcaacaactacagagttggtgccagaatggtcactgagtatgatcttccagtgaatggcgaattgtctgagggaggtgattgtccctgggcagttctggttgagagtggacagtgcgatttgatgctgatatcatacatgggaattgatttccagaaccaaggtgacagagtttaccgtctgctcaacaccacgttgacattctatggggttgcccatgagggagagacccttgagtatgacatcagagtgaccggttttgccaaacgtttggatggtggcatctccatgttcttctttgagtatgactgctatgtcaatgggaggcttctcattgagatgagagatggctgtgctggcttcttcacaaatgaggagcttgatgcgggaaagggtgtggtgttcacaagaggggatttggctgccagagctaagattccaaagcaagatgtttctccctatgctgtcgctccctgccttcacaaaacaaaactcaacgaaaaggagatgcagaccttggttgacaaagattgggcttccgtttttggctcaaagaatggcatgccggagatcaactacaaactctgcgcacgtaagatgctcatgattgatagagtcaccagcattgaccataagggaggtgtgtacggtttgggtcagttggttggtgagaaaatcttggagagggaccattggtacttcccatgccattttgttaaggatcaagtcatggctggatctcttgtcagcgacggttgttcacaaatgctcaagatgtacatgatctggctcggtttgcaccttaccaccggaccatttgacttcagacccgtcaacggacacccgaacaaagttaggtgtaggggtcagatatctcctcataagggaaagttggtctacgtcatggagatcaaagagatgggattcgacgaggataacgatccgtacgccattgctgacgtcaacatcattgacgttgatttcgaaaagggtcaagatttcagccttgatagaatcagcgactacggaaagggggatcttaacaaaaagatcgtcgtggacttcaagggcattgctctcaagatgcagaagagatccacgaacaagaacccctccaaagttcagcccgtttttgctaacggtgcagccactgtgggaccggaagcgtccaaggccagctctggtgccagtgctagtgcttctgctgcccctgcgaagcctgctttctcagcagatgttcttgcgccaaagccagttgcacttcctgaacatatcctcaagggtgacgctctcgctccgaaagaaatgtcctggcatcccatgtcaaaacttcctggcaacccgacgccgttcttctcccctagttcttaccctccgagggcaatttgcttcatccctttccctggcaacccacttgacaacaattgcaaagctggagaaatgcctctgaactggtacaacatgtcagagttcatgtgtggaaaagttagcaactgcttgggaccagagttcgcaagatttgataagtcaaatacgagcagaagccctgcttttgatttggctcttgtgactagagttgttgaagtcacaaacatggaacatggcaagttcctgaatgttgattgcaatcccagcaaaggcacaatggtgggggagtttgactgtcctcaagatgcgtggttctttgatggttcttgcaatgatgggcacatgccttattccatcatcatggaaatcggacttcagacatccggtgttctcaccagtgtgttgaaagcaccactgacgatggacaaagatgacattctctttaggaaccttgatgcaagtgctgaaatggtgaggccagatgtggatgtgagggggaaaaccataaggaatgtgaccaagtgcactggatatgcaatgttgggaaagatggggattcacagattcacgtttgagttgtctgttgatggcgtggttttctacaaaggaagcacttcctttggatggttcactccagaggtgtttgctcagcaagctggacttgacaatgggaaaaagacggagccttggtgcaaaactaacaacacgagtgtgagaagagttgaaatcgcatcagccaaaggcaaagaacagctgactgagaaacttccagatgcaactaatgctcaagttctcagaaggtcagaacagtgtgagtatttggattacctcaacattgctcctgattctgggctgcatgggaaaggatatgcgcatggacacaaagatgttaacccacaagactggttcttctcttgtcacttttggtttgatcctgtgatgcctggatctttgggaattgagtcaatgttccagctcattgaggcatttgcggtggaccagaacataccgggagaatacaatgtgagcaatccgacctttgcccatgcccctggaaaaacggcgtggaagtaccgtggtcaattgacaccaaagaaccgtgcgatggactgtgaggtgcacatagtttcaatcacagcctctcctgaaaatggaggctacgttgacatagtggcagatggagcactttgggttgatggtctccgtgtgtatgaagccaaagaactcagagttcgtgttgtcagtgcaaaacctcaagccattccggatgttcaacaacagccacccagcgcaaaagcggaccctgggaaaactggagttgcactcagtccgactcagttgagagatgtcctgcttgaagtggacaatccattgtatcttggtgttgaaaactccaatttggtgcagtttgaatccaaacctgcaacttcttcaaggattgtcagtatcaaaccatgctccataagtgatcttggtgacaagtccttcatggaaacgtacaatgtgtcagcacctctgtacactggagcaatggccaagggaattgcgtctgcggaccttgtcattgctgctgggaagaggaagatattgggttcttttggagcgggtgggcttccaatgcaccatgtgagggcagctttggagaagatacaagcggctctgcctcaaggaccatatgctgtgaacctcattcattcaccttttgacagcaacttggaaaaggggaatgttgatctcttcctcgaaaagggcgttactgtggtggaggcttctgcattcatgaccctcactccccaagttgttcgttaccgtgcagccggactctcaaggaacgctgatgggagtgtcaacatcagaaaccgtatcattggaaaagtgtccagaacagaactcgccgaaatgttcatcagaccggctccggaacacctccttgagaaactcatagcttctggtgagataacacaagaacaagccgaacttgcccgtcgtgttcctgtcgcagacgacatcgctgttgaagctgattctggtggtcacactgacaaccgtcccatccacgtcatcttgcctttgatcatcaaccttaggaacagactgcacagagagtgtggttatcctgcgcaccttagagtcagagttggagctggaggcggtgttggctgcccacaagctgctgcggctgccctcacaatgggagctgccttcatagtgactgggactgtcaatcaagttgctaaacagtccgggacatgtgacaacgtgagaaaacaactcagtcaagccacctacagtgacatttgcatggctccagcagctgatatgtttgaggaaggtgtgaaactccaagttctcaagaagggaacaatgttcccatcaagagctaacaaattgtacgaactcttttgcaagtacgactctttcgattcaatgcctcctgctgaacttgaaaggatcgagaagaggatcttcaagagggcacttcaagaggtctgggaagagaccaaggacttttacatcaatggtttgaagaatccagagaagatacagagagcggaacatgaccccaaactcaagatgtctttgtgtttcagatggtatcttggtcttgcatcacgttgggccaacatgggtgctcctgatcgtgtcatggactatcaagtctggtgtggtccagccattggagccttcaatgacttcatcaaaggaacatatcttgatcctgctgtctctaatgagtacccatgtgttgtccagatcaaccttcagattttgcgtggtgcatgttacctgaggcgtcttaatgctctgagaaatgatccgaggattgatcttgagactgaagatgctgcctttgtctatgagccaacgaatgcgctttgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaatcacgagtggatgactgtcacgactgactcatgactgactactagtgctagcctcgaggtcgacacaactttgtataataaagttgtctagacctaggagctgtgctgggtaactcacatgagtcactggtcacatcagcggccgcagcttatagtaaagatttttttgttaataaaatgaaagttaatatttatggatttatttgaacatatttacaagtttttgttaataaatttatttacagaagtgttaaatttgaaaatgtgttaaatgagagttaatatttatggatataatattactttatttaaaaataaaatgaatttatattaaaatatgatttggtaaaagatattataaagaggaacttggatgagaaagacgacgatgggcaaaagttgcatggcacaccgcttttgttcagtaacatctgcactgtggcgcctttttcacactcaccatgcatgctgccacgtcagctttcacactatgacaccactggccatacacgttgccacctcagctttctcctcttctcactatgacacgactggccatgcatgcatgcatgctgccacctcagctcccgcctcttcacccgtgtctttctctcatgtcgcagtgctgcgtgccaacctcttctctctataaatagagagaagagaatgatggttaaactcaaaccaaaacaagaaaacatacacaaatagcaaaacggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacccagtccaagcccggcctagcacgatgatcatgagtgttgctattgatgtatgttaatactatacacagtcatcgtgtgtgttttataaaactgtaagcttaggatgtttgaggctaatgtaattagcactacaccgtaataaatgagaggtttactttatgttttaataatgttcttacccttgctgctctctaaactgtaatggcgtacggttagctaaactaaagtaaaaatcgattcgcttgagtaaaattagtgaccgggaaagatcatcgactactactgctcagagatgtaatcggtaattaagacttcaagctcaataattaattaggagtaaatctggcttcgaatttttaaattgtcaacttccaaagaaggattggcaagactcaatctcaattgcccaacaaacatatggctctttacaaatttggaatctctttttgatggcaagaacgtcgtaattcctctgtcgatctcatgtaattaccaaactcatctacttattactttctttatatgcacttactgatgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 63 - DNA, 22042 bp, Artificial sequence
  plasmid pDAB108224
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagtgatcagcagagtgagtcctgagtcctgagtatcactcatcttaattaagcggccgcatcagtaagtgcatataaagaaagtaataagtagatgagtttggtaattacatgagatcgacagaggaattacgacgttcttgccatcaaaaagagattccaaatttgtaaagagccatatgtttgttgggcaattgagattgagtcttgccaatccttctttggaagttgacaatttaaaaattcgaagccagatttactcctaattaattattgagcttgaagtcttaattaccgattacatctctgagcagtagtagtcgatgatctttcccggtcactaattttactcaagcgaatcgatttttactttagtttagctaaccgtacgccattacagtttagagagcagcaagggtaagaacattattaaaacataaagtaaacctctcatttattacggtgtagtgctaattacattagcctcaaacatcctaagcttacagttttataaaacacacacgatgactgtgtatagtattaacatacatcaatagcaacactcatgatcatcgtgctaggccgggcttggactgggtgacctaagtgattaagctaactactcagaacgcaagtgagtctgtcgcaatgacagaggcttgaacatcaatgaagagatcaccttgttcgttgtggaactgaagtgcatgtttgtgctggctatgtccaccactctgattggatctgagggtgatgtagaagggtttgtcttgtgggaccggtctgtgttggactatcctctgaatggagttcgggagtgcagcttgtcccagcgttctcctcacccagaccaacattgcttgaaaggcaagatcattgacaaagggatcatgtgcatcagtgtcagttgcaaactctcctctggctgcatctgatccaggaacagcagaacacttggcaacaagctggctcttggtgcagctgagaacgtcatcaatgcctctgaacgcaggaccatgaaagagagtcttgccatcatagactgacccttgcaaagcaggatctgcatcaaggctcggaggctgcatggttgcattggcaggtggagcaccttggttggacaacactatgacagctctgtaggctggaacaagttttccacttgagaacgtcttgagcgtcgcttggacattcaccctcccactcggagcagtggacggtgtgagggtcacttcacagttgacgtctccatcaacagtgacacctttgaagagctgtgcgtcatctatggcccagagagagtagccagggaagagtccaaggcaggtctcagcaaggctcccaatagcaagggtcattggcaacacccttctgccttgtatgacatgatcctccaagaagggattggacttggcactgatctttctatgcagggtgatcgtgtcacttccaactttcttggatggtgtcctccagtttccaacaaggatctcagcaggacttgatcccaacacaatcctcgcaactgtatcagcacctccttcacgaggaatgatctgaactcccatttcttgaaactgtttcttgagttgaggtgtcaccatcccaccatcccagggaccaaagcagatggacttgacactgacatccttcgcaagttccaaacccatcttgttgagagcttcgtttgccatcgcatagtcagactgaccaacattgccgtggaaaccagcaagggagctgaagagaaccatgtgtttgaggttggcacgatcaactgcagccagaagattctccaacccagtgactttggtcccaaagacagcatcaaactcgtcagggagtttcttctctatgagacgatcacggagcacaccagaagcgtgaacgattccactaactctggcaccaagctgggactctgcatccctaactgctttggcaacatctgcagcagagttcacatcacaagagctgtagatcgctttgccacccagagcttcaatggcagcaatggagcttctcacttcacgagcaccaagaacagatcccacaagtttcgtgacagcccttggagtgggtttgggtccttcaccagcactgaaggccctcttcaactcttgggtggcagctttctgcacagccttctcatcagtgatgccagcacaccatgctggttcagacgcagaaactttgctacgacccaacagaatgtacttgcctccagcaatctgacgcgtgatctcacggatgcaaagaggtgtgatcccacgagcacctccagaaaccagaagcacatcgtctttcgctatctgtctctgagggttcccagtctccaacttggcagctctgattgtgcatctttgctggtttgctccaatcccaacctctctgattctgatgtcagcacacgccatctccctaactatggcaactgcagcatcttctgggtgcatcccttgagcaatgtccacaccacggctgaacacatcagattctgaccactccaaccctattgtcttgcagagtccaaagatcgctccacgctgtgctctcttgagtgcgtcagaagtgccttgagaggtgaatccaagtctgccgtcaagcctagccacaccgatgaaggcaggacgacctccagccacagcagtgcagagagaggctttggcaaacttcgcacacatgagtgtgaaacccagtatctcagctggttcaaacctttctgcttgctggcttatgaagcctcccaacgctccaaatctttgctcagcctctttgatggccttctcagctgattctgctgaaaggtccttagccagaacatgacgaatggcagctgcaccagctctctgagccaactgcaatccctcaaaggtcaagacaactgcacaggctcccaacaccctcacaagagcaagtgtcaactctgagccatcgtcaacgacaagaactggacggttctccggtctttccagaatcagttcatctggccttctgatgtcaaccacctttgcgtgcatcagtgacaaatcgtcacagtcagcaccatgaactgaatcaatcttcacagctggtgcagcaccggcacttgcaggagcggctgcagccggagcaggggctgatccaccagctatctcagccttcatggcatcgaccacttctccaaccgttctggtccttgacaaagcatcgacatctttggcctcaacgttcagcatggcttgaacctcagaaaggatttccacacgcttgatgctatcaatcccaagctctgtttccaactccatgtctgactctatcatgtcagtctcgtatccagtctttgcagccaaaacctccatcacaacagtttcagctttttcaaggagttcgttgctgacagctggtgccgcggcagcgggagcaggagcggctgcagctggcgcaggagcagaacccccagctatctcagccttcatggcatcaaccacctctcccaccgtccttgttctggaaagagcatcaacatctttggcctccacattcaacatcgcttgaacctcagagaggatttcaacacgtttgatggagtcaattccaagctcggtctccagttccatgtcagattcaatcatgtcggtctcatagccagttttcgcagcaaggacttccatcacaactgtctcagccttttccaggagttctgaggagacggccggtgcggctgcagctggagccggtgccgcggctgcgggtgcaggagcggctgcagctggcgcaggcgcggaacttccagcgatctccgccttcatcgcatcaacgacctcaccaactgttctggtccttgagagggcatccacatccttagcctccacattgagcattgcttggacttcactgaggatctcaacacgcttgatgctgtcaatgcccaattccgtctcaagttccatgtcagactcaatcatgtcagtctcatagccggtttttgcagccagcacttccatgacaactgtttcagccttctcaagcaattcgttgctgacagctggtgccgcggctgcgggtgcaggtgcggcagctgccggcgcaggagcagagcctccagcaatctcagccttcatcgcatcgacaacttcccccacagttcttgtcctactgagtgcatcaacatctttagcctcaacgttgagcatggcttgcacctcagagaggatctccactctcttgatggaatctattccaagttcggtctccaattccatgtctgactcaatcatgtccgtttcgtaaccagtttttgcagcaaggacttccatcacaactgtttcggctttctccagcaactcattgctgacggcaggagcggctgcagctggagcaggtgccgcggcagcaggtgcaggtgcggctgcagctggcgcactagcagagcttccggcaatttcagccttcatggcgtccacgacctcaccgactgttctggttcttgaaagcgcatcgacatcttttgcctccacgttcaacatagcttggacctcagacaagatttcaacacgtttgatgctatctattcccaactcggtttcaagctccatgtcactttcaatcatgtcggtctcgtaaccagtcttagctgcgagcacctccatcacaaccgtctcggccttttccaggagttcggatgaaacagctggcgcgggcgcggccggtgctggtgcagctggagctggagctgcggctgccggtgcaggtgccgcggcagctggcgcaggcgcgctccctccagcaatctccgccttcatggcatccacaacctcacccactgtccttgttcttgaaagtgcatcaacatccttagcttcaacattgagcatggcttggacttcactcaggatctccactcttttgatggaatcgatcccaagctctgtctccaattccatatcagattcaatcatgtcggtctcatagccagtctttgcagccaaaacctccatcacaaccgtctcagccttctccaagagttctgaagaaacggcaggtgcaggtgcagctggagcaggtgccgcggctgcgggtgcaggagcggctgcagctggcgcgggcgcagaccctccagcaatttcagccttcatggcatccacaacctcaccaacggtcctcgttctggacagagcatcaacatccttcgcttccacgttcagcatagcttggacctcactgaggatttcaacacgtttgatgctgtctatcccaagttctgtctccaattccatgtcagactcaatcatgtcagtctcatagccggttttagctgccaagacctccatcacgacggtctcagctttttcaaggagttcgtttgagacggccggagcggctgcagctggagctggagccgcggcagcgggaccaggagcggcagcggccggcgcaggagcggagcctccagctatctcagccttcatggcattgacaacctcaccgacagttctggtccttgagagagcatccacatccttagcttccacattgagcatggcttggacttcactgaggatttccacacgcttgatggaatcaattccaagctccgtctcaagctccatgtctgattctatcatgtcagtttcgtagccagttttggcagcaaggacttccatcacaacagtttctgccttttcgagcagctcattagaaacagctggtgcagctgcagctggagccgctttagccggtgcaggtgcggcagctgccggcgccggagcggaagaaccagcgatttctgccttcatagcgttgacaacttcacccactgttctcgtcctagagagagcatcaacatctttcgcctcaacgttaagcatagcttggacttcagaaagaatttcaaccctcttgatgctgtcaattcccaactcagtctcaagctccatgtccgcctcaatcatgtctgtttcgtatccagtcttggcagcgagaacctccatcacaactgtctcagctttctcaagcaactcgttggacacggcgggagcaggagcacttgcaacgggagcggcaggggcagcggctttaacaggcgccggagcagtctgttgctgttgctgttgctgaagggaagaagcatcaacacttccataaccatccagctcagccagcatggacttgaggatggcacgatgtttctccacaacagcagtgtcaactgcaggcttggctgaagctgcagcagtcttggcttcctccttggcagcagcaagtttggagttggcttctgcagctgcacgtttggcgtcgtcaagctgcctctgagcgtcttgaagctccttctgaagcctttcagcctccctcttggcagcttcgtcaaccacaggttcaggagccttgatgagtggtgcagcacccttgaggtatgtgacacatcttccgtcgttcatggcagcatccctcactttcttggtcttgtcactgacataggtggcagctgaaagtctgagtgtggttctctttttcttgatggcttgcatcctcgtggcatcaggagcatcccacttgtcaaacccttgaagattgacaccagccacaaccagctgaactgcagcatccctcaactgtatgtcagagtccgtgccagaagctgggttcacagacactgtgacaacagacgggtcatctttgagggtttcagaaacaagtttgctgagaacttgtttcggtccaaactcaacaaagattctcgcaccagcttggtgcatgttcctcacttgggtcaggaacttcacagatgaggtcatgtgttgagtgagcatctctctggcatccgtcggataggtctctccagaaacattgctgaagagctttgtttctgctttgggtgtacggaaggaaaccttggatatgacatctttgaaagctgagctggcattttccatctgtggagaatggaaggcagactcacaagcaagaggcacaactctgaacccttccttctgcaatctggcactttcagcttgaatcccttcaacagacccagtaatgacagtctgagacggagagtttgagtttccaagccagacgttggcagcttgaaccttgatgttctctgcgttgggtcctatgacagctgccatgcaacctttgggtgtggcaggtgcatctttgcctcccatgatccttgcccttctgcaaacaagttcaaacaactcatctctgtcaacacaaccagctgcatagagcgcagcaaactcacccaagctgtgtccagctgcaaagtctggagtgaatccagcttccttgaaaatctcaaaggcaccaagagcacatgccagggttgacggctggctgtatgctgtgagtgagattttcttgtgatcttgttctggctcacgttcgtacggtttccttgggtacaggacttgagagactctttcaaagtctttgtcacttccagcaaccttggactgtgcagcgtccattgcagcaatggactgtctgaactgaggccagttcatcgcaacttcactgaacatgtgtgtgtactgagcaccttgtccagagaagagtgcagcaacagcaccattggtggcaatgcctttggcacggaaagaaactccttctctcggaagcctccacgcttctttggtcacatctttggcaaactgagcacatatagcacgaagcgtggagcacgcatcctccgcatctttgaccaagaatcccagtctcgcattggtcgcaggtatgctcccagggaacttgaactgttctccaaacttgacacacttgatgtaggcagtattcttgactgtctcattctccttgatcgcagcttcaaactctttcagctgagcttcacaaaggctctgcaacgcagcaggagttgcagccatcatcaacaccggttgtggacgtttgttgagtctgtacgctgtcgtgtgctctggttcagcctcttccaacactgcatggtagttggcacctccaaagccaaagctggatattccagcacgtctcggaacaccaggtggagggaaccagggtctgttcatcgtgttgatgtagagggatgactcattgatgggagtgttgtcatagagattgggtggattgtccacattgatcgttccaggcaaagtcttgtgtttgagagccatgatgaccttgatcattccagcaagaccagcaacagccttcaaatgaccaatactggacttgatacttccaactgcaactttctctgtgttcccttcaccatacgctttgtcaaacaagttcctcaacgcagtcaactcaatcctatctccaactggagtgccagtcccatgaccctcaaccaaagtgacagtggcagggtcaacgcaggcacgattgtatgcacgtctcaaggcttcctcttgaccactgattgtgggagtgtagatgccagctgctttgccatcacttgagcttgcacaaccacgaatcacagcatgaatctcatcaccatccctcactgcatctgcataacgtttgagcaccaacatggctgatccctcaccaatgagcatccctttcgttttctcatcatacgctctcacacttgggtccgtgctgaacacaggtgtctttgagaaagccatgtacatcccaatggagttgtctgtgcaggttgcaccagtgaccatcatgtcgcagtcaccatagagcagttcatcaatcgcaaccttgactgctatcaaggagcttgcacatgcagcatccacaacgcagttcatgccatccaagttgaatgtgttggtgcatctgccagcagtgacattcccaaggaatccagggaaagagtcaagtctccattctgggaagttcgctttgtacttctccacagccactttgacatcttcctctggcatccccatctttctcaagactttctccacaaccacatagttgagtctgctgtagaactcatgtgaactcttctgtccacctccaatgccaagcacgcatcctatgtttttcttctcctttccaagtgcatcaatcccagcatcttgaagtgcttctttgaccttgagaagtgagatggtctgattcgcatcagaatcttccatctggaacatgttgagaccaaactcacgcgcatcaaagtcatactcaggaatgaaacctcctctcttgcagtagattttgtcctttgtggtcttgactgggtcaaagtacgcagtcacatcaacacgatcctcaggaagatcagacaggcaatcaatgccagcccttatggtctcccatgactctctcaccgtggttccacaaggaagtatggcgctcatgcctatgatcgcaatcctcgtgtccatctcacctcctttctgctcttgcagcctcgctgccatttttggttgtggatccgttttgctatttgtgtatgttttcttgttttggtttgagtttaaccatcattctcttctctctatttatagagagaagaggttggcacgcagcactgcgacatgagagaaagacacgggtgaagaggcgggagctgaggtggcagcatgcatgcatgcatggccagtcgtgtcatagtgagaagaggagaaagctgaggtggcaacgtgtatggccagtggtgtcatagtgtgaaagctgacgtggcagcatgcatggtgagtgtgaaaaaggcgccacagtgcagatgttactgaacaaaagcggtgtgccatgcaacttttgcccatcgtcgtctttctcatccaagttcctctttataatatcttttaccaaatcatattttaatataaattcattttatttttaaataaagtaatattatatccataaatattaactctcatttaacacattttcaaatttaacacttctgtaaataaatttattaacaaaaacttgtaaatatgttcaaataaatccataaatattaactttcattttattaacaaaaaaatctttactataagctgcggccgcttaattaagatgagtgatactcaggactcaggactcactctgctgatcactagtgctagcctcgaggtcgacacaactttgtatacaaaagttgtctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatgcttcagcacacttggcttccgaagcctcccaatctgaccctcttgtcagatgaggttcatctctggaggattcctcttgaccagcctgagtcacaacttcaagaccttgctgccaccctgagcagtgatgaattggcgagggcaaacagattctactttccagaacacagaaggcgtttcactgctgggagaggcatcctcagatccatcttgggtggatacttgggagtggaaccgggtcaagtcaagtttgattatgagtcccgtgggaaaccgatccttggtgacagatttgctgagagtggactcctgttcaacttgtctcacagccagaaccttgccttgtgtgctgtcaactacacgcgtcaaataggcattgatcttgaatatctgcgtccaacatctgacttggagtctcttgcaaagaggttctttctcccaagagaatatgaactcttgaggtcactccctgatgagcagaaacagaagattttctttcgttactggacttgcaaagaggcttatctcaaagcaacgggagatggaatagccaaacttgaagagatcgagatagcactcaccccaacagaacctgccaagctccaaacagctcctgcgtggtctctgttggagcttgtgccagatgacaattgtgttgcagctgtggctgttgcgggttttggttggcagcccaagttctggcattactgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 64 - DNA, 23255 bp, Artificial sequence
  plasmid pDAB108225
aattacaacggtatatatcctgccagtcagcatcatcacaccaaaagttaggcccgaatagtttgaaattagaaagctcgcaattgaggtctacaggccaaattcgctcttagccgtacaatattactcaccggatcctaaccggtttaattaaggcgcgccatgcccgggcaagcggccgcacaagtttgtacaaaaaagcaggcttctagacctaggactaggcactgagtgactcactgacctgactgagtgactggcggccgcatcagtaagtgcatataaagaaagtaataagtagatgagtttggtaattacatgagatcgacagaggaattacgacgttcttgccatcaaaaagagattccaaatttgtaaagagccatatgtttgttgggcaattgagattgagtcttgccaatccttctttggaagttgacaatttaaaaattcgaagccagatttactcctaattaattattgagcttgaagtcttaattaccgattacatctctgagcagtagtagtcgatgatctttcccggtcactaattttactcaagcgaatcgatttttactttagtttagctaaccgtacgccattacagtttagagagcagcaagggtaagaacattattaaaacataaagtaaacctctcatttattacggtgtagtgctaattacattagcctcaaacatcctaagcttacagttttataaaacacacacgatgactgtgtatagtattaacatacatcaatagcaacactcatgatcatcgtgctaggccgggcttggactgggtgacctaagtgattaagctaactactcaaagcgcattcgttggctcatagacaaaggcagcatcttcagtctcaagatcaatcctcggatcatttctcagagcattaagacgcctcaggtaacatgcaccacgcaaaatctgaaggttgatctggacaacacatgggtactcattagagacagcaggatcaagatatgttcctttgatgaagtcattgaaggctccaatggctggaccacaccagacttgatagtccatgacacgatcaggagcacccatgttggcccaacgtgatgcaagaccaagataccatctgaaacacaaagacatcttgagtttggggtcatgttccgctctctgtatcttctctggattcttcaaaccattgatgtaaaagtccttggtctcttcccagacctcttgaagtgccctcttgaagatcctcttctcgatcctttcaagttcagcaggaggcattgaatcgaaagagtcgtacttgcaaaagagttcgtacaatttgttagctcttgatgggaacattgttcccttcttgagaacttggagtttcacaccttcctcaaacatatcagctgctggagccatgcaaatgtcactgtaggtggcttgactgagttgttttctcacgttgtcacatgtcccggactgtttagcaacttgattgacagtcccagtcactatgaaggcagctcccattgtgagggcagccgcagcagcttgtgggcagccaacaccgcctccagctccaactctgactctaaggtgcgcaggataaccacactctctgtgcagtctgttcctaaggttgatgatcaaaggcaagatgacgtggatgggacggttgtcagtgtgaccaccagaatcagcttcaacagcgatgtcgtctgcgacaggaacacgacgggcaagttcggcttgttcttgtgttatctcaccagaagctatgagtttctcaaggaggtgttccggagccggtctgatgaacatttcggcgagttctgttctggacacttttccaatgatacggtttctgatgttgacactcccatcagcgttccttgagagtccggctgcacggtaacgaacaacttggggagtgagggtcatgaatgcagaagcctccaccacagtaacgcccttttcgaggaagagatcaacattccccttttccaagttgctgtcaaaaggtgaatgaatgaggttcacagcatatggtccttgaggcagagccgcttgtatcttctccaaagctgccctcacatggtgcattggaagcccacccgctccaaaagaacccaatatcttcctcttcccagcagcaatgacaaggtccgcagacgcaattcccttggccattgctccagtgtacagaggtgctgacacattgtacgtttccatgaaggacttgtcaccaagatcacttatggagcatggtttgatactgacaatccttgaagaagttgcaggtttggattcaaactgcaccaaattggagttttcaacaccaagatacaatggattgtccacttcaagcaggacatctctcaactgagtcggactgagtgcaactccagttttcccagggtccgcttttgcgctgggtggctgttgttgaacatccggaatggcttgaggttttgcactgacaacacgaactctgagttctttggcttcatacacacggagaccatcaacccaaagtgctccatctgccactatgtcaacgtagcctccattttcaggagaggctgtgattgaaactatgtgcacctcacagtccatcgcacggttctttggtgtcaattgaccacggtacttccacgccgtttttccaggggcatgggcaaaggtcggattgctcacattgtattctcccggtatgttctggtccaccgcaaatgcctcaatgagctggaacattgactcaattcccaaagatccaggcatcacaggatcaaaccaaaagtgacaagagaagaaccagtcttgtgggttaacatctttgtgtccatgcgcatatcctttcccatgcagcccagaatcaggagcaatgttgaggtaatccaaatactcacactgttctgaccttctgagaacttgagcattagttgcatctggaagtttctcagtcagctgttctttgcctttggctgatgcgatttcaactcttctcacactcgtgttgttagttttgcaccaaggctccgtctttttcccattgtcaagtccagcttgctgagcaaacacctctggagtgaaccatccaaaggaagtgcttcctttgtagaaaaccacgccatcaacagacaactcaaacgtgaatctgtgaatccccatctttcccaacattgcatatccagtgcacttggtcacattccttatggttttccccctcacatccacatctggcctcaccatttcagcacttgcatcaaggttcctaaagagaatgtcatctttgtccatcgtcagtggtgctttcaacacactggtgagaacaccggatgtctgaagtccgatttccatgatgatggaataaggcatgtgcccatcattgcaagaaccatcaaagaaccacgcatcttgaggacagtcaaactcccccaccattgtgcctttgctgggattgcaatcaacattcaggaacttgccatgttccatgtttgtgacttcaacaactctagtcacaagagccaaatcaaaagcagggcttctgctcgtatttgacttatcaaatcttgcgaactctggtcccaagcagttgctaacttttccacacatgaactctgacatgttgtaccagttcagaggcatttctccagctttgcaattgttgtcaagtgggttgccagggaaagggatgaagcaaattgccctcggagggtaagaactaggggagaagaacggcgtcgggttgccaggaagttttgacatgggatgccaggacatttctttcggagcgagagcgtcacccttgaggatatgttcaggaagtgcaactggctttggcgcaagaacatctgctgagaaagcaggcttcgcaggggcagcagaagcactagcactggcaccagagctggccttggacgcttccggtcccacagtggctgcaccgttagcaaaaacgggctgaactttggaggggttcttgttcgtggatctcttctgcatcttgagagcaatgcccttgaagtccacgacgatctttttgttaagatccccctttccgtagtcgctgattctatcaaggctgaaatcttgacccttttcgaaatcaacgtcaatgatgttgacgtcagcaatggcgtacggatcgttatcctcgtcgaatcccatctctttgatctccatgacgtagaccaactttcccttatgaggagatatctgacccctacacctaactttgttcgggtgtccgttgacgggtctgaagtcaaatggtccggtggtaaggtgcaaaccgagccagatcatgtacatcttgagcatttgtgaacaaccgtcgctgacaagagatccagccatgacttgatccttaacaaaatggcatgggaagtaccaatggtccctctccaagattttctcaccaaccaactgacccaaaccgtacacacctcccttatggtcaatgctggtgactctatcaatcatgagcatcttacgtgcgcagagtttgtagttgatctccggcatgccattctttgagccaaaaacggaagcccaatctttgtcaaccaaggtctgcatctccttttcgttgagttttgttttgtgaaggcagggagcgacagcatagggagaaacatcttgctttggaatcttagctctggcagccaaatcccctcttgtgaacaccacaccctttcccgcatcaagctcctcatttgtgaagaagccagcacagccatctctcatctcaatgagaagcctcccattgacatagcagtcatactcaaagaagaacatggagatgccaccatccaaacgtttggcaaaaccggtcactctgatgtcatactcaagggtctctccctcatgggcaaccccatagaatgtcaacgtggtgttgagcagacggtaaactctgtcaccttggttctggaaatcaattcccatgtatgatatcagcatcaaatcgcactgtccactctcaaccagaactgcccagggacaatcacctccctcagacaattcgccattcactggaagatcatactcagtgaccattctggcaccaactctgtagttgttgacctcggcatccatgagtgtgacccttgtcacaagcaggtattcacgagcaggcagcctcacccttctggggtacttgtctatgacagcaaactccggaccaaaaaccttagctatgtcaccctctgcaaactccaggagttcctcatagttgaacacctcagttttgccagaggtcagttcctccttggtcatctcccaacatggcttcttgttggtcttgacacgaagcgccatttttggttgtggatccgttttgctatttgtgtatgttttcttgttttggtttgagtttaaccatcattctcttctctctatttatagagagaagaggttggcacgcagcactgcgacatgagagaaagacacgggtgaagaggcgggagctgaggtggcagcatgcatgcatgcatggccagtcgtgtcatagtgagaagaggagaaagctgaggtggcaacgtgtatggccagtggtgtcatagtgtgaaagctgacgtggcagcatgcatggtgagtgtgaaaaaggcgccacagtgcagatgttactgaacaaaagcggtgtgccatgcaacttttgcccatcgtcgtctttctcatccaagttcctctttataatatcttttaccaaatcatattttaatataaattcattttatttttaaataaagtaatattatatccataaatattaactctcatttaacacattttcaaatttaacacttctgtaaataaatttattaacaaaaacttgtaaatatgttcaaataaatccataaatattaactttcattttattaacaaaaaaatctttactataagctgcggccgcttaattaagatgagtgatactcaggactcaggactcactctgctgatcactagtgctagcctcgaggtcgacacaactttgtatacaaaagttgtctaggatctgcttttacatgcgagacacatcttctaaagtaattttaataatagttactatattcaagatttcatatatcaaatactcaatattacttctaaaaaattaattagatataattaaaatattacttttttaattttaagtttaattgttgaatttgtgactattgatttattattctactatgtttaaattgttttatagatagtttaaagtaaatataagtaatgtagtagagtgttagagtgttaccctaaaccataaactataagatttatggtggactaattttcatatatttcttattgcttttaccttttcttggtatgtaagtccgtaactggaattactgtgggttgccatgacactctgtggtcttttggttcatgcatggatcttgcgcaagaaaaagacaaagaacaaagaaaaaagacaaaacagagagacaaaacgcaatcacacaaccaactcaaattagtcactggctgatcaagatcgccgcgtccatgtatgtctaaatgccatgcaaagcaacacgtgcttaacatgcactttaaatggctcacccatctcaacccacacacaaacacattgcctttttcttcatcatcaccacaaccacctgtatatattcattctcttccgccacctcaatttcttcacttcaacacacgtcaacctgcatatgcgtgtcatcccatgcccaaatctccatgcatgttccaaccaccttctctcttatataatacctataaatacctctaatatcactcacttctttcatcatccatccatccagagtactactactctactactataataccccaacccaactcatattcaatactactctaggatccacaaccaaaaatggctgcaaggaacgtgagtgcggctcatgagatgcatgacgagaagaggatagctgttgtgggcatggctgttcagtatgctggatgcaaaacgaaagacgagttctgggaagttctcatgaatggaaaagttgagagcaaagtgatcagcgacaaacgtcttggttcaaattaccgtgctgaacactacaaagctgaaaggagcaagtatgctgacaccttctgcaatgagacatatggaactcttgatgagaacgaaatagacaatgagcatgaactccttttgaaccttgccaaacaagccttggctgaaacatctgtcaaagattcaacaagatgtggcatagtttctggatgcctcagcttcccgatggacaacctccaaggtgaactcttgaatgtgtaccagaaccatgttgagaagaaacttggtgccagagttttcaaagatgcctctcactggtcagaaagagaacagtccaacaaaccagaggctggtgacagaagaatcttcatggaccctgcttcctttgttgctgaggaactcaatcttggcgctctccactactctgttgatgctgcctgtgccactgcgctctatgtgctcagactggcgcaagatcacttggtctctggtgcagctgatgtgatgctttgtggtgcaacatgcctgccggagccgtttttcatactctctgggttctcaaccttccaagccatgcctgttggaacgggtcagaatgtgtccatgccgctgcacaaagattctcaaggattgacccctggtgaaggaggttccatcatggtcctcaaacgtttggatgacgcaatcagagatggagatcacatctatggaacacttttgggagccaatgtcagcaacagtggcactggtctgccacttaaaccccttttgccgtcagagaaaaagtgcctcatggacacctacacacgtatcaatgtgcatccccacaagattcagtatgttgaatgccatgcaactgggactccacaaggtgatcgtgtggaaattgatgctgtgaaggcttgctttgaaggcaaagtcccacgttttggaaccacaaaagggaactttggacacacattggtggcagctgggtttgctggcatgtgcaaagtgcttctctccatgaagcacgggatcattccacccactccgggaatagatgacgaaacgaagatggaccctctggttgtctctggtgaggccattccctggccagaaacgaatggagaaccgaagcgtgctggtctctcagcgtttggatttggtgggaccaatgctcatgctgtctttgaggaacatgacccaagcaatgctgcatgcactggccatgactccatttctgctctctctgcacgttgtggtggtgagtcaaacatgagaatagcaatcactgggatggatgccacttttggtgctttgaaaggattggatgcttttgaaagggccatctacactggtgctcatggtgctataccactcccagaaaagagatggagattcctggggaaagacaaggacttccttgatctttgtggagtcaaagcaacaccgcatggctgttacattgaagatgttgaagttgatttccagaggctgaggactccaatgactcctgaagatatgctcttgcctcaacagcttctggctgtcaccacaattgatagggccatattggactctggcatgaagaaaggtggaaatgtggctgtctttgtggggttggggaccgatcttgaactctaccgtcaccgtgcaagggttgctctcaaggagagagtgaggcctgaagccagcaagaaactcaatgacatgatgcagtacatcaatgattgtgggacaagcacttcttacaccagctacataggcaacttggttgcaacaagggtcagttcacaatggggcttcacgggaccttccttcacaatcacagaaggcaacaattctgtgtacagatgtgctgaacttggcaaatacctcttggaaacgggagaggttgatggggttgtggttgcgggtgttgatctctgtgggagtgctgagaacctttacgtcaagtcaaggcgtttcaaggtgtctacatctgacaccccgagagccagctttgatgcagctgctgatggttactttgttggagagggctgtggtgcatttgtgctcaagcgtgagacaagctgcaccaaggatgacagaatctatgcttgcatggatgccatagttcctggaaatgttccatctgcatgtttgagagaggcattggatcaagccagagtcaagcctggagacatcgagatgttggagctttctgctgattcagcgaggcatttgaaggacccgtctgttctcccaaaggaactcactgctgaggaagagattggcggacttcagacgattcttcgtgacgatgacaagctcccaaggaatgttgcaactggaagtgtcaaggccactgttggtgacactggttatgcttctggtgctgccagtttgattaaggctgcgctttgcatctacaaccgttacctgcccagcaatggagatgactgggatgaacctgcacctgaagcaccctgggacagcacactctttgcgtgccagacctcaagagcttggttgaagaaccctggtgagagacgttatgcggctgtttccggagtcagtgaaaccagaagttgctacagtgtgctgctttctgaagcagagggacactacgagagagagaacagaatcagtttggatgaggaagcacccaagctcattgtgttgagagcagactcccatgaagagattcttggaagattggacaagataagggaaaggttcttgcagcccacgggtgctgcacccagagagtctgaattgaaggcgcaagcccgtaggatctttcttgaactccttggtgagacccttgcccaagatgcagcttcatctggaagtcagaagccccttgctctcagcttggtctccactccatccaagctccagagagaggtggaacttgcggcaaaaggcattccgagatgtctcaagatgagacgtgattggagttcccctgctggaagcagatatgcgcctgagcctttggccagtgacagagttgccttcatgtatggagaaggaaggagcccttactatggcatcacacaagacattcataggatttggcctgaacttcatgaggtcatcaatgagaaaacaaaccgtctctgggctgaaggtgacagatgggtcatgccaagggccagcttcaagagtgagcttgagtcacaacagcaagagtttgacagaaacatgattgaaatgttccgtcttggaatcctcacctcaattgccttcacaaacctggcgagagatgttctcaacatcacgcccaaagcagcctttggactcagtttgggagagatttccatgatctttgctttctccaagaaaaacggtttgataagcgatcagttgacaaaggatttgagagagtcagatgtctggaacaaagctctggctgttgagttcaatgcgctcagagaagcctggggcattccacagtctgtcccaaaagatgagttctggcaaggttacatagtgaggggaacgaaacaagacatagaagcagccatagcaccagactcaaagtatgtgaggttgaccatcatcaatgatgccaacactgctctcatcagtggaaagcctgatgcatgcaaagctgcgattgctcgtcttggtggcaacatccctgcgcttccagtcactcaaggcatgtgtgggcattgcccagaggtgggaccttacaccaaggacatcgcaaagatccacgccaaccttgagttccctgtggttgatggtcttgatctctggactaccataaaccagaagaggcttgtgccaagagccacgggtgccaaagatgaatgggctccttcatcctttggggagtatgctggacagctctatgagaaacaagccaacttccctcagatagttgaaaccatctacaagcagaactatgatgtgtttgttgaagttgggccaaacaatcacagaagcacagcagtgagaaccacgcttggaccacagagaaaccaccttgctggtgccatagacaagcagaacgaggatgcttggacgacaatagtcaagctcgtggcttcattgaaggctcaccttgttcctggagtgaccatcagtccgctctaccactccaagctcgttgcagaggctgaggcttgttatgctgcgctctgtaaaggtgagaaacccaagaaaaacaagtttgtgagaaagattcagttgaatggcagattcaacagcaaggcagaccccatctcctcagcagaccttgcatccttcccacctgcggaccctgcgattgaagctgccatctcttcaaggatcatgaagcctgtggctccgaaattctatgcgcgtctcaacattgatgagcaagatgagaccagagatccgatcttgaacaaggacaatgcgccttccagctccagctcttccagcagttcctcttccagcagttcatctccgtctcctgctccttcagctccagttcagaagaaagctgccccagctgcggagacaaaagctgttgccagtgctgatgcacttcgtagtgccctgcttgatcttgactccatgcttgcgctcagctctgcaagtgcttctggcaaccttgttgagactgcgccatctgatgccagtgtcattgtccctccgtgcaacattgctgatcttggcagcagagctttcatgaaaacttatggtgtttctgcgcctctgtacaccggtgcaatggccaagggaattgcctctgcggacttggtgatcgcagctggaaggcaaggaatccttgcgtcatttggtgctggaggccttccaatgcaagttgtgcgtgagtccattgaaaagattcaagctgccctgcccaatggaccatatgctgtcaacctcatccattctccttttgacagcaaccttgagaagggaaatgttgatctcttcttggaaaagggtgtcacttttgttgaggcttcagccttcatgacgttgacaccgcaagttgtcagatacagagcggctgggttgacgaggaatgcagatgggtcagtcaacataaggaacagaatcattgggaaagtctccagaactgagctggctgaaatgttcatgcgtcctgcacctgagcatcttttgcagaagctcattgcttctggggagatcaatcaagaacaagctgagttggccagacgtgttcctgtggctgatgacattgcggttgaagctgattctggtggacacactgacaaccgtccaatccatgtcattctgcctctgattatcaacctgagggataggcttcacagagagtgtggatacccagcaaacctgagggttcgtgttggtgctgggggtggcattgggtgtccccaagctgcgctggcaactttcaacatgggtgcctctttcattgtcactggaacagtgaaccaagttgccaaacaatctgggacgtgtgacaatgtgaggaaacagcttgcgaaagcaacttactcagatgtttgcatggcaccggcagctgacatgtttgaggaaggtgtgaaacttcaagttttgaagaaaggaacaatgttcccttcaagagccaacaaactctatgagttgttctgcaagtatgattcttttgagtccatgcctccagcagagcttgcgagggttgagaaaagaatcttcagtcgtgcattggaagaggtctgggatgagaccaagaacttctacatcaaccgtctccacaacccagagaagatacagagggctgagagggaccccaaactgaagatgtcactgtgtttcagatggtatctgtccctggcttcaaggtgggccaacactggagcttctgacagagtcatggactaccaagtttggtgtggtcctgccattggttcattcaatgatttcatcaaaggaacttaccttgatccggcagtggcaaatgagtacccgtgtgttgtgcagatcaacaaacagattcttagaggagcgtgcttcttgaggcgtcttgaaatactgagaaatgcaaggctttcagatggtgcagctgcacttgtggcgagcattgatgacacatatgtccctgctgagaagctgtgagtagttagcttaatcacttaggtcacctcgagtatcaaaatctatttagaaatacacaatattttgttgcaggcttgctggagaatcgatctgctatcataaaaattacaaaaaaattttatttgcctcaattattttaggattggtattaaggacgcttaaattatttgtcgggtcactacgcatcattgtgattgagaagatcagcgatacgaaatattcgtagtactatcgataatttatttgaaaattcataagaaaagcaaacgttacatgaattgatgaaacaatacaaagacagataaagccacgcacatttaggatattggccgagattactgaatattgagtaagatcacggaatttctgacaggagcatgtcttcaattcagcccaaatggcagttgaaatactcaaaccgccccatatgcaggagcggatcattcattgtttgtttggttgcctttgccaacatgggagtccaaggttggcgcgccgaattcgcggccgcttaattaactactgtcactgaggccgtagacgagtacggactgatctaactagtgctagcctcgaggtcgacacccagctttcttgtacaaagtggttgcggccgcttaattaaatttaaattcaattaatgcaatcttgattttcaacaacgaaggtaatggcgtaaaagaaaaaatgtatgttattgtattgatctttcatgatgttgaagcgtgccataatatgatgatgtataattaaaatattaactgtcgcattttattgaaatggcactgttatttcaaccatatctttgattctgttacatgacacgactgcaagaagtaaataatagacgccgttgttaaagaattgctatcatatgtgcctaactagagggaatttgagcgtcagacctaatcaaatattacaaaatatctcactctgtcgccagcaatggtgtaatcagcgcagacaaatggcgtaaagatcgcggaaaaacctccccgagtggcatgatagctgcctctgtattgctgatttagtcagccttatttgacttaagggtgccctcgttagtgacaaattgctttcaaggagacagccatgccccacactttgttgaaaaacaaattgcctttggggagacggtaaagccagttgctcttcaataaggaatgtcgaggaggcaatgtaaccgcctctggtagtacacttctctaatccaaaaatcaatttgtattcaagataccgcaaaaaacttatggtttaaaccctgcaggactagtccagaaggtaattatccaagatgtagcatcaagaatccaatgtttacgggaaaaactatggaagtattatgtaagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaggtaccagatctggatcccaaaccatgtctccggagaggagaccagttgagattaggccagctacagcagctgatatggccgcggtttgtgatatcgttaaccattacattgagacgtctacagtgaactttaggacagagccacaaacaccacaagagtggattgatgatctagagaggttgcaagatagatacccttggttggttgctgaggttgagggtgttgtggctggtattgcttacgctgggccctggaaggctaggaacgcttacgattggacagttgagagtactgtttacgtgtcacataggcatcaaaggttgggcctaggatctacattgtacacacatttgcttaagtctatggaggcgcaaggttttaagtctgtggttgctgttataggccttccaaacgatccatctgttaggttgcatgaggctttgggatacacagcccggggtacattgcgcgcagctggatacaagcatggtggatggcatgatgttggtttttggcaaagggattttgagttgccagctcctccaaggccagttaggccagttacccaaatctgagtagttagcttaatcacctagagctcgatcggcggcaatagcttcttagcgccatcccgggttgatcctatctgtgttgaaatagttgcggtgggcaaggctctctttcagaaagacaggcggccaaaggaacccaaggtgaggtgggctatggctctcagttccttgtggaagcgcttggtctaaggtgcagaggtgttagcgggatgaagcaaaagtgtccgattgtaacaagatatgttgatcctacgtaaggatattaaagtatgtattcatcactaatataatcagtgtattccaatatgtactacgatttccaatgtctttattgtcgccgtatgtaatcggcgtcacaaaataatccccggtgactttcttttaatccaggatgaaataatatgttattataatttttgcgatttggtccgttataggaattgaagtgtgcttgaggtcggtcgccaccactcccatttcataattttacatgtatttgaaaaataaaaatttatggtattcaatttaaacacgtatacttgtaaagaatgatatcttgaaagaaatatagtttaaatatttattgataaaataacaagtcaggtattatagtccaagcaaaaacataaatttattgatgcaagtttaaattcagaaatatttcaataactgattatatcagctggtacattgccgtagatgaaagactgagtgcgatattatggtgtaatacataggaattcgtttaaacgatctgcgtctaattttcggtccaacttgcacaggaaagacgtcgaccgcggtagctcttgcccagcagactgggcttccagtcctttcgctcgatcgggtccaatgttgtcctcagctgtgaaccggaagcggacgaccaacagtggaagaactgaaaggaacgagccgtctataccttgatgatcggcctctggtgaagggtatcatcgcagccaagcaagctcatgaaaggctgatgggggaggtgtataattatgaggcccacggcgggcttattctttagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaatagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtagctcatccatgcacgccgacaagaacagaaattccgtcgagttaacgcagccgcttacgacggattcgaaggtcatccattcggaatgtattagtttgcaccagctccgcgtcacacctgtcttcatttgaataagatgttagcaattgtttttagctttgtcttgttgtggcagggcggcaagtgcttcagacatcattctgttttcaaattttatgctggagaacagcttcttaattcctttggaaataatagactgcgtcttaaaattcagatgtctggatatagatatgattgtaaaataacctatttaagtgtcatttagaacataagttttatgaatgttcttccattttcgtcatcgaacgaataagagtaaatacaccttttttaacattacaaataagttcttatacgttgtttatacaccgggaatcatttccattattttcgcgcaaaagtcacggatattcgtgaaagcgacataaactgcgaaatttgcggggagtgtcttgagtttgcctcgaggctagcgcatgcacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttaaacatcatccgtcggatggcgttgcgagagaagcagtcgatccgtgagatcagccgacgcaccgggcaggcgcgcaacacgatcgcaaagtatttgaacgcaggtacaatcgagccgacgttcacgcggaacgaccaagcaagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccgcggtgtctcgcacacggcttcgacggcgtttctggcgcgtttgcagggccatagacggccgccagcccagcggcgagggcaaccagcccggtgagcgtcggaaagggtcgacggatcttttccgctgcataaccctgcttcggggtcattatagcgattttttcggtatatccatcctttttcgcacgatatacaggattttgccaaagggttcgtgtagactttccttggtgtatccaacggcgtcagccgggcaggataggtgaagtaggcccacccgcgagcgggtgttccttcttcactgtcccttattcgcacctggcggtgctcaacgggaatcctgctctgcgaggctggccggctaccgccggcgtaacagatgagggcaagcggatggctgatgaaaccaagccaaccaggaagggcagcccacctatcaaggtgtactgccttccagacgaacgaagagcgattgaggaaaaggcggcggcggccggcatgagcctgtcggcctacctgctggccgtcggccagggctacaaaatcacgggcgtcgtggactatgagcacgtccgcgagctggcccgcatcaatggcgacctgggccgcctgggcggcctgctgaaactctggctcaccgacgacccgcgcacggcgcggttcggtgatgccacgatcctcgccctgctggcgaagatcgaagagaagcaggacgagcttggcaaggtcatgatgggcgtggtccgcccgagggcagagccatgacttttttagccgctaaaacggccggggggtgcgcgtgattgccaagcacgtccccatgcgctccatcaagaagagcgacttcgcggagctggtattcgtgcagggcaagattcggaataccaagtacgagaaggacggccagacggtctacgggaccgacttcattgccgataaggtggattatctggacaccaaggcaccaggcgggtcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggtccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaggccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactggcatttcaggaacaagcgggcactgctcgacgcacttgcttcgctcagtatcgctcgggacgcacggcgcgctctacgaactgccgataaacagaggattaaaattgacaattgtgattaaggctcagattcgacggcttggagcggccgacgtgcaggatttccgcgagatccgattgtcggccctgaagaaagctccagagatgttcgggtccgtttacgagcacgaggagaaaaagcccatggaggcgttcgctgaacggttgcgagatgccgtggcattcggcgcctacatcgacggcgagatcattgggctgtcggtcttcaaacaggaggacggccccaaggacgctcacaaggcgcatctgtccggcgttttcgtggagcccgaacagcgaggccgaggggtcgccggtatgctgctgcgggcgttgccggcgggtttattgctcgtgatgatcgtccgacagattccaacgggaatctggtggatgcgcatcttcatcctcggcgcacttaatatttcgctattctggagcttgttgtttatttcggtctaccgcctgccgggcggggtcgcggcgacggtaggcgctgtgcagccgctgatggtcgtgttcatctctgccgctctgctaggtagcccgatacgattgatggcggtcctgggggctatttgcggaactgcgggcgtggcgctgttggtgttgacaccaaacgcagcgctagatcctgtcggcgtcgcagcgggcctggcgggggcggtttccatggcgttcggaaccgtgctgacccgcaagtggcaacctcccgtgcctctgctcacctttaccgcctggcaactggcggccggaggacttctgctcgttccagtagctttagtgtttgatccgccaatcccgatgcctacaggaaccaatgttctcggcctggcgtggctcggcctgatcggagcgggtttaacctacttcctttggttccgggggatctcgcgactcgaacctacagttgtttccttactgggctttctcagcccccgagcgcttagtgggaatttgtaccccttatcgaaccgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagagagctggggaagactatgcgcgatctgttgaaggtggttctaagcctcgtcttgcgatggcatttcgatccattcccattccgcgctcaagatggcttcccctcggcagttcatcagggctaaatcaatctagccgacttgtccggtgaaatgggctgcactccaacagaaacaatcaaacaaacatacacagcgacttattcacacgagctca

SEQ ID NO: 65 - DNA, 261 bp, Artificial
  PUFA OrfA Repeat 1
gtgtccaacgagttgcttgagaaagctgagacagttgtgatggaggttctcgctgccaagactggatacgaaacagacatgattgaggcggacatggagcttgagactgagttgggaattgacagcatcaagagggttgaaattctttctgaagtccaagctatgcttaacgttgaggcgaaagatgttgatgctctctctaggacgagaacagtgggtgaagttgtcaacgctatgaaggcagaaatcgctggttcttcc

SEQ ID NO: 66 - DNA, 261 bp, Artificial
  PUFA OrfA Repeat 3
gtctcaaacgaactccttgaaaaagctgagaccgtcgtgatggaggtcttggcagctaaaaccggctatgagactgacatgattgagtctgacatggaattggagacagaacttgggatagacagcatcaaacgtgttgaaatcctcagtgaggtccaagctatgctgaacgtggaagcgaaggatgttgatgctctgtccagaacgaggaccgttggtgaggttgtggatgccatgaaggctgaaattgctggagggtct

SEQ ID NO: 67 - DNA, 261 bp, Artificial
  PUFA OrfA Repeat 4
gtttcttcagaactcttggagaaggctgagacggttgtgatggaggttttggctgcaaagactggctatgagaccgacatgattgaatctgatatggaattggagacagagcttgggatcgattccatcaaaagagtggagatcctgagtgaagtccaagccatgctcaatgttgaagctaaggatgttgatgcactttcaagaacaaggacagtgggtgaggttgtggatgccatgaaggcggagattgctggagggagc

SEQ ID NO: 68 - DNA, 261 bp, Artificial
  PUFA OrfA Repeat 8
gtctcctcagaactcctggaaaaggctgagacagttgtgatggaagtccttgctgcgaaaactggctatgagaccgacatgattgaatctgacatggaactggagaccgagcttggaattgactccatcaaacgtgttgaaatcctctctgaggttcaagcgatgttgaatgtggaggccaaagatgttgatgctctttccagaacaaggacggtgggagaggtggttgatgccatgaaggctgagatagctgggggttct

SEQ ID NO: 69 - DNA, 261 bp, Artificial
  PUFA OrfA Repeat 5
gtttcatccgaactcctggaaaaggccgagacggttgtgatggaggtgctcgcagctaagactggttacgagaccgacatgattgaaagtgacatggagcttgaaaccgagttgggaatagatagcatcaaacgtgttgaaatcttgtctgaggtccaagctatgttgaacgtggaggcaaaagatgtcgatgcgctttcaagaaccagaacagtcggtgaggtcgtggacgccatgaaggctgaaattgccggaagctct

SEQ ID NO: 70 - DNA, 261 bp, Artificial
  PUFA OrfA Repeat 9
gtcagcaacgaactccttgaaaaagctgaaactgttgtgatggaggttttggctgcaaagactggatacgagactgacatgatagagtcagacatggagttggaaacagagcttgggattgatagcatcaagcgtgtggaaatcctttctgaggttcaagccatgctgaacgttgaggccaaagatgtcgatgctttgtcaaggaccagaacggttggagaagtggtcgatgccatgaaggctgagatagctggtggatca

SEQ ID NO: 71 - DNA, 261 bp, Artificial
  PUFA OrfA Repeat 2
gtttctaatgagctgctcgaaaaggcagaaactgttgtgatggaagtccttgctgccaaaactggctacgaaactgacatgatagaatcagacatggagcttgagacggagcttggaattgattccatcaagcgtgtggaaatcctcagtgaagtccaagccatgctcaatgtggaagctaaggatgtggatgctctctcaaggaccagaactgtcggtgaggttgtcaatgccatgaaggctgagatagctggaggctcc

SEQ ID NO: 72 - DNA, 261 bp, Artificial
  PUFA OrfA Repeat 6
gtcagcaatgagttgctggagaaagccgaaacagttgtgatggaagtccttgctgcaaaaactggttacgaaacggacatgattgagtcagacatggaattggagaccgaacttggaatagattccatcaagagagtggagatcctctctgaggtgcaagccatgctcaacgttgaggctaaagatgttgatgcactcagtaggacaagaactgtgggggaagttgtcgatgcgatgaaggctgagattgctggaggctct

SEQ ID NO: 73 - DNA, 261 bp, Artificial
  PUFA OrfA Repeat 7
gtcagcaacgaattgcttgagaaggctgaaacagttgtcatggaagtgctggctgcaaaaaccggctatgagactgacatgattgagtctgacatggaacttgagacggaattgggcattgacagcatcaagcgtgttgagatcctcagtgaagtccaagcaatgctcaatgtggaggctaaggatgtggatgccctctcaaggaccagaacagttggtgaggtcgttgatgcgatgaaggcggagatcgctggaagttcc

What is claimed is:

1. A genetically modified soybean plant or seed thereof, comprising:
    a first polynucleotide operably linked to a seed-specific promoter, the polynucleotide encoding a polyunsaturated fatty acid (PUFA) synthase polypeptide comprising an amino acid sequence that is at least 95% identical to SEQ ID NO: 1, wherein the first polynucleotide comprises a nucleotide sequence that is at least 90% identical to SEQ ID NO:6;
    a second polynucleotide operably linked to a seed-specific promoter, the polynucleotide encoding a PUFA synthase system polypeptide comprising an amino acid sequence that is at least 95% identical to SEQ ID NO:2, wherein the second polynucleotide comprises a nucleotide sequence that is at least 90% identical to SEQ ID NO:7;
    a third polynucleotide operably linked to a seed-specific promoter, the polynucleotide encoding a PUFA synthase polypeptide comprising an amino acid sequence that is at least 95% identical to SEQ ID NO:3, wherein the third polynucleotide comprises a nucleotide sequence that is at least 90% identical to SEQ ID NO:8;
    a fourth polynucleotide operably linked to a seed-specific promoter, the polynucleotide encoding a phosphopantetheinyl transferase (PPTase) polypeptide comprising an amino acid sequence that is at least 95% identical to SEQ ID NO:5, wherein the fourth polynucleotide comprises a nucleotide sequence that is at least 90% identical to SEQ ID NO: 10; and
    a fifth polynucleotide encoding an acyl-CoA synthetase (ACoAS) comprising an amino acid sequence that is at least 95% identical to SEQ ID NO:4, wherein seed of the soybean plant comprises an oil comprising docosahexaenoic acid (C22:6, n-3) (DHA) and docosapentaenoic acid (C22:5, n-6) (DPA(n-6)).

2. The genetically modified soybean plant or seed thereof of claim 1, wherein the first polynucleotide encodes the PUFA synthase polypeptide of SEQ ID NO:1, wherein the second polynucleotide encodes the PUFA synthase polypeptide of SEQ ID NO:2, and wherein the third polynucleotide encodes the PUFA synthase polypeptide of SEQ ID NO:3.

3. The genetically modified soybean plant or seed thereof of claim 2, wherein the first polynucleotide comprises the nucleotide sequence of SEQ ID NO:6, wherein the second polynucleotide comprises the nucleotide sequence of SEQ ID NO:7, and wherein the third polynucleotide comprises the nucleotide sequence of SEQ ID NO:8.

4. The genetically modified soybean plant or seed thereof of claim 1, wherein the fourth polynucleotide encodes the PPTase of SEQ ID NO:5.

5. The genetically modified soybean plant or seed thereof of claim 1, wherein each of the polynucleotides is operably linked to the PvDlec2 promoter.

6. The genetically modified soybean plant or seed thereof of claim 1, wherein the fifth polynucleotide encodes the ACoAS of SEQ ID NO:4.

7. The genetically modified soybean plant or seed thereof of claim 1, further comprising a polynucleotide encoding an acetyl CoA carboxylase (ACCase) or a polynucleotide encoding a type 2 diacylglycerol acyltransferase (DGAT2).

8. The genetically modified soybean plant or seed thereof of claim 1, wherein the oil comprises 0.7%-12% combined docosahexaenoic acid (C22:6, n-3) (DHA)+docosapentaenoic acid (C22:5, n-6) (DPA(n-6)) by weight of total fatty acids.

9. The genetically modified soybean plant or seed thereof of claim 8, wherein the oil comprises 0.7%-2.8% DHA by weight of total fatty acids.

10. The genetically modified soybean plant or seed thereof of claim 8, wherein the oil comprises 0.5%-1.9% DPA(n-6) by weight of total fatty acids.

11. The genetically modified soybean plant or seed thereof of claim 9, wherein the oil comprises 0.5%-1.9% DPA(n-6) by weight of total fatty acids.

12. The genetically modified soybean plant or seed thereof of claim 8, wherein the plant or seed thereof is a soybean seed.

13. A food product comprising the soybean seed of claim 12.

14. A functional food comprising the genetically modified soybean plant or seed thereof of claim 8.

15. A pharmaceutical product comprising the genetically modified soybean plant or seed thereof of claim 8.

16. The genetically modified soybean plant or seed thereof of claim 8,
   wherein the PUFA synthase polypeptide encoded by the first polynucleotide comprises the chloroplast transit peptide (CTP) encoded by SEQ ID NO:28 or SEQ ID NO:29 at its amino terminus,
   wherein the PUFA synthase polypeptide encoded by the second polynucleotide comprises the chloroplast transit peptide (CTP) encoded by SEQ ID NO:28 or SEQ ID NO:29 at its amino terminus,
   wherein the PUFA synthase polypeptide encoded by the third polynucleotide comprises the chloroplast transit peptide (CTP) encoded by SEQ ID NO:28 or SEQ ID NO:29 at its amino terminus, and
   wherein the PPTase encoded by the fourth polynucleotide comprises the chloroplast transit peptide (CTP) encoded by SEQ ID NO:28 or SEQ ID NO:29 at its amino terminus.

17. The genetically modified soybean plant material or seed thereof of claim 16,
   wherein the PUFA synthase polypeptide encoded by the first polynucleotide comprises the chloroplast transit peptide (CTP) encoded by SEQ ID NO:29 at its amino terminus,
   wherein the PUFA synthase polypeptide encoded by the second polynucleotide comprises the chloroplast transit peptide (CTP) encoded by SEQ ID NO:29 at its amino terminus,
   wherein the PUFA synthase polypeptide encoded by the third polynucleotide comprises the chloroplast transit peptide (CTP) encoded by SEQ ID NO:29 at its amino terminus, or
   wherein the PPTase encoded by the fourth polynucleotide comprises the chloroplast transit peptide (CTP) encoded by SEQ ID NO:29 at its amino terminus.

18. A genetically modified soybean seed comprising:
   a first polynucleotide operably linked to a seed-specific promoter, the polynucleotide comprising the nucleotide sequence of SEQ ID NO:6;
   a second polynucleotide operably linked to a seed-specific promoter, the polynucleotide comprising the nucleotide sequence of SEQ ID NO:7;
   a third polynucleotide operably linked to a seed-specific promoter, the polynucleotide comprising the nucleotide sequence of SEQ ID NO:8;
   a fourth polynucleotide operably linked to a seed-specific promoter, the polynucleotide comprising the nucleotide sequence of SEQ ID NO:10; and
   a fifth polynucleotide encoding the acyl-CoA synthetase (ACoAS) of SEQ ID NO:4,
   wherein the plant seed comprises a seed oil with a polyunsaturated fatty acid profile consisting essentially of 0.36%-8.00% docosahexaenoic acid (C22:6, n-3) (DHA) and 0.3%-3.98% docosapentaenoic acid (C22:5, n-6) (DPA(n-6)) by weight of total fatty acids.

19. The genetically modified soybean seed of claim 8, wherein the fifth polynucleotide consists of a nucleotide sequence at least 90% identical to SEQ ID NO:9.

20. The genetically modified soybean seed of claim 8, wherein the fifth polynucleotide consists of a nucleotide sequence at least 90% identical to SEQ ID NO:30.

21. The genetically modified soybean seed of claim 20,
   wherein the PUFA synthase polypeptide encoded by the first polynucleotide comprises the chloroplast transit peptide (CTP) encoded by SEQ ID NO:28 or SEQ ID NO:29 at its amino terminus,
   wherein the PUFA synthase polypeptide encoded by the second polynucleotide comprises the chloroplast transit peptide (CTP) encoded by SEQ ID NO:28 or SEQ ID NO:29 at its amino terminus,
   wherein the PUFA synthase polypeptide encoded by the third polynucleotide comprises the chloroplast transit peptide (CTP) encoded by SEQ ID NO:28 or SEQ ID NO:29 at its amino terminus, and
   wherein the PPTase encoded by the fourth polynucleotide comprises the chloroplast transit peptide (CTP) encoded by SEQ ID NO:28 or SEQ ID NO:29 at its amino terminus.

22. The genetically modified soybean seed of claim 21, wherein the PUFA synthase polypeptide encoded by the first polynucleotide comprises the chloroplast transit peptide (CTP) encoded by SEQ ID NO:29 at its amino terminus,
   wherein the PUFA synthase polypeptide encoded by the second polynucleotide comprises the chloroplast transit peptide (CTP) encoded by SEQ ID NO:29 at its amino terminus,
   wherein the PUFA synthase polypeptide encoded by the third polynucleotide comprises the chloroplast transit peptide (CTP) encoded by SEQ ID NO:29 at its amino terminus, or
   wherein the PPTase encoded by the fourth polynucleotide comprises the chloroplast transit peptide (CTP) encoded by SEQ ID NO:29 at its amino terminus.

\* \* \* \* \*